US007628989B2

(12) United States Patent
Jakobovits et al.

(10) Patent No.: US 7,628,989 B2
(45) Date of Patent: Dec. 8, 2009

(54) METHODS OF INDUCING AN IMMUNE RESPONSE

(75) Inventors: Aya Jakobovits, Beverly Hills, CA (US); Pia M. Challita-Eid, Encino, CA (US); Mary Faris, Los Angeles, CA (US); Wangmao Ge, Los Angeles, CA (US); Rene S. Hubert, Los Angeles, CA (US); Karen Jane Meyrick Morrison, Santa Monica, CA (US); Robert Kendall Morrison, Santa Monica, CA (US); Arthur B. Raitano, Los Angeles, CA (US); Daniel E. H. Afar, Fremont, CA (US)

(73) Assignee: Agensys, Inc., Santa Monica, CA (US)

( * ) Notice: Subject to any disclaimer, the term of this patent is extended or adjusted under 35 U.S.C. 154(b) by 145 days.

(21) Appl. No.: 11/155,906

(22) Filed: Jun. 17, 2005

(65) Prior Publication Data

US 2007/0048299 A1 Mar. 1, 2007

Related U.S. Application Data

(62) Division of application No. 10/121,024, filed on Apr. 10, 2002.

(60) Provisional application No. 60/286,630, filed on Apr. 25, 2001, provisional application No. 60/283,112, filed on Apr. 10, 2001, provisional application No. 60/282,739, filed on Apr. 10, 2001.

(51) Int. Cl.
*A61K 39/00* (2006.01)

(52) U.S. Cl. ......................... 424/184.1; 514/2; 530/350

(58) Field of Classification Search ............. 424/184.1; 514/2; 530/350
See application file for complete search history.

(56) References Cited

U.S. PATENT DOCUMENTS 6,150,090 A 11/2000 Baltimore
6,265,565 B1 7/2001 Bandman et al.
6,410,516 B1 6/2002 Baltimore et al.
6,414,220 B1 7/2002 Vrontakis
6,500,938 B1 12/2002 Au-Young et al.
6,518,411 B1 2/2003 Murray et al.
6,639,063 B1 10/2003 Edwards et al.
6,812,339 B1 * 11/2004 Venter et al. ............. 536/24.31
2001/0051335 A1 12/2001 Lalgudi
2002/0022248 A1 2/2002 Xu et al.
2002/0098543 A1 7/2002 Bandman et al.
2002/0102543 A1 8/2002 Friedrich et al.
2002/0103125 A1 8/2002 Ashkenazi et al.
2002/0123463 A1 9/2002 Ashkenazi et al.
2002/0127584 A1 9/2002 Baker et al.
2002/0132252 A1 9/2002 Ashkenazi et al.
2002/0137139 A1 9/2002 Byatt et al.
2002/0142961 A1 10/2002 Ashkenazi et al.
2002/0147140 A1 10/2002 Rosen et al.
2002/0156263 A1 10/2002 Chen
2002/0160384 A1 10/2002 Ashkenazi et al.
2002/0169284 A1 11/2002 Ashkenazi et al.
2002/0177164 A1 11/2002 Ashkenazi et al.
2002/0192706 A1 12/2002 Ashkenazi et al.
2002/0192763 A1 12/2002 Xu et al.
2003/0003531 A1 1/2003 Ashkenazi et al.
2003/0004102 A1 1/2003 Ashkenazi et al.
2003/0004311 A1 1/2003 Baker et al.
2003/0017542 A1 1/2003 Baker et al.
2003/0017563 A1 1/2003 Baker et al.
2003/0022298 A1 1/2003 Baker et al.
2003/0027162 A1 2/2003 Ashkenazi et al.
2003/0027163 A1 2/2003 Ashkenazi et al.
2003/0027272 A1 2/2003 Baker et al.
2003/0027280 A1 2/2003 Baker et al.
2003/0027985 A1 2/2003 Ashkenazi et al.
2003/0032023 A1 2/2003 Ashkenazi et al.
2003/0032102 A1 2/2003 Baker et al.
2003/0032104 A1 2/2003 Baker et al.

(Continued)

FOREIGN PATENT DOCUMENTS

CA 2255286 6/1999

(Continued)

OTHER PUBLICATIONS

White et al, 2001 (Ann Rev Med, 52: 125-145).*

(Continued)

*Primary Examiner*—Larry R. Helms
*Assistant Examiner*—Minh Tam Davis
(74) *Attorney, Agent, or Firm*—Morrison & Foerster LLP

(57) ABSTRACT

Novel genes designated and set forth in FIG. 2 and their respective encoded proteins, and variants thereof, are described wherein a gene of the invention exhibits tissue specific expression in normal adult tissue, and is aberrantly expressed in the cancers such as those listed in Table I. Consequently, of gene products of a gene of FIG. 2 provide diagnostic, prognostic, prophylactic and/or therapeutic targets for cancer. A gene of FIG. 2 or fragment thereof, its encoded protein, or variants thereof, or a fragment thereof, can be used to elicit a humoral or cellular immune response; antibodies or T cells reactive with a gene product of FIG. 2 can be used in active or passive immunization.

4 Claims, 383 Drawing Sheets

U.S. PATENT DOCUMENTS

| | | | |
|---|---|---|---|
| 2003/0032106 | A1 | 2/2003 | Baker et al. |
| 2003/0032110 | A1 | 2/2003 | Baker et al. |
| 2003/0032113 | A1 | 2/2003 | Baker et al. |
| 2003/0032155 | A1 | 2/2003 | Baker et al. |
| 2003/0036136 | A1 | 2/2003 | Baker et al. |
| 2003/0036137 | A1 | 2/2003 | Baker et al. |
| 2003/0036139 | A1 | 2/2003 | Baker et al. |
| 2003/0036143 | A1 | 2/2003 | Baker et al. |
| 2003/0036156 | A1 | 2/2003 | Baker et al. |
| 2003/0036157 | A1 | 2/2003 | Baker et al. |
| 2003/0036162 | A1 | 2/2003 | Baker et al. |
| 2003/0036180 | A1 | 2/2003 | Baker et al. |
| 2003/0105002 | A1 | 6/2003 | Murray et al. |
| 2004/0048253 | A1 | 3/2004 | Panzer et al. |

FOREIGN PATENT DOCUMENTS

| | | |
|---|---|---|
| CA | 2401868 | 8/2001 |
| CN | 1352259 | 6/2002 |
| EP | 1 033 401 | 9/2000 |
| EP | 1 067 182 | 1/2001 |
| EP | 1 074 617 | 2/2001 |
| EP | 1 101 820 | 5/2001 |
| EP | 1 293 569 | 3/2003 |
| EP | 1 308 459 | 5/2003 |
| JP | 05-328975 | 12/1993 |
| JP | 07-145197 | 6/1995 |
| JP | 09-191883 | 7/1997 |
| JP | 11-332579 | 12/1999 |
| JP | 12-270871 | 10/2000 |
| WO | WO-89/07614 | 8/1989 |
| WO | WO-92/12997 | 8/1992 |
| WO | WO-92/15015 | 9/1992 |
| WO | WO-92/15681 | 9/1992 |
| WO | WO-93/16178 | 8/1993 |
| WO | WO-94/21783 | 9/1994 |
| WO | WO-95/14772 | 6/1995 |
| WO | WO 96/24379 | 8/1996 |
| WO | WO-97/39133 | 10/1997 |
| WO | WO-98/14568 | 4/1998 |
| WO | WO-98/21328 | 5/1998 |
| WO | WO-98/30585 | 7/1998 |
| WO | WO-98/32853 | 7/1998 |
| WO | WO-98/45435 | 10/1998 |
| WO | WO-98/46755 | 10/1998 |
| WO | WO-98/49299 | 11/1998 |
| WO | WO-99/03990 | 1/1999 |
| WO | WO-99/05272 | 2/1999 |
| WO | WO-99/06439 | 2/1999 |
| WO | WO-99/06548 | 2/1999 |
| WO | WO-99/06549 | 2/1999 |
| WO | WO-99/06550 | 2/1999 |
| WO | WO-99/06551 | 2/1999 |
| WO | WO-99/06552 | 2/1999 |
| WO | WO-99/06553 | 2/1999 |
| WO | WO-99/06554 | 2/1999 |
| WO | WO-99/18207 | 4/1999 |
| WO | WO-99/19469 | 4/1999 |
| WO | WO-99/22000 | 5/1999 |
| WO | WO-99/25825 | 5/1999 |
| WO | WO-99/31117 | 6/1999 |
| WO | WO-99/31236 | 6/1999 |
| WO | WO-99/33982 | 7/1999 |
| WO | WO-99/38972 | 8/1999 |
| WO | WO-99/40189 | 8/1999 |
| WO | WO-99/46281 | 9/1999 |
| WO | WO-99/48920 | 9/1999 |
| WO | WO-99/53051 | 10/1999 |
| WO | WO-99/58660 | 11/1999 |
| WO | WO-99/58675 | 11/1999 |
| WO | WO-99/63088 | 12/1999 |
| WO | WO-99/64576 | 12/1999 |
| WO | WO-00/04149 | 1/2000 |
| WO | WO-00/04153 | 1/2000 |
| WO | WO-00/06589 | 2/2000 |
| WO | WO-00/06714 | 2/2000 |
| WO | WO-00/09676 | 2/2000 |
| WO | WO-00/14251 | 3/2000 |
| WO | WO-00/18914 | 4/2000 |
| WO | WO-00/32221 | 6/2000 |
| WO | WO-00/34466 | 6/2000 |
| WO | WO-00/50629 | 8/2000 |
| WO | WO-00/52047 | 9/2000 |
| WO | WO-00/53756 | 9/2000 |
| WO | WO-00/53758 | 9/2000 |
| WO | WO-00/55173 | 9/2000 |
| WO | WO-00/55320 | 9/2000 |
| WO | WO-00/58473 | 10/2000 |
| WO | WO-00/61622 | 10/2000 |
| WO | WO-00/69900 | 11/2000 |
| WO | WO-00/70092 | 11/2000 |
| WO | WO-00/73454 | 12/2000 |
| WO | WO 00/73801 | 12/2000 |
| WO | WO-00/75279 | 12/2000 |
| WO | WO-00/75661 | 12/2000 |
| WO | WO-00/77024 | 12/2000 |
| WO | WO-01/00848 | 1/2001 |
| WO | WO-01/02568 | 1/2001 |
| WO | WO-01/09318 | 2/2001 |
| WO | WO-01/12660 | 2/2001 |
| WO | WO-01/22920 | 4/2001 |
| WO | WO-01/25272 | 4/2001 |
| WO | WO-01/30972 | 5/2001 |
| WO | WO-01/34802 | 5/2001 |
| WO | WO-01/40466 | 6/2001 |
| WO | WO-01/42467 | 6/2001 |
| WO | WO-01/42472 | 6/2001 |
| WO | WO-01/51628 | 7/2001 |
| WO | WO-01/51633 | 7/2001 |
| WO | WO-01/54477 | 8/2001 |
| WO | WO-01/55312 | 8/2001 |
| WO | WO-01/55314 | 8/2001 |
| WO | WO-01/55328 | 8/2001 |
| WO | WO-01/55367 | 8/2001 |
| WO | WO-01/57058 | 8/2001 |
| WO | WO-01/57182 | 8/2001 |
| WO | WO-01/57186 | 8/2001 |
| WO | WO-01/57188 | 8/2001 |
| WO | WO-01/57190 | 8/2001 |
| WO | WO-01/57272 | 8/2001 |
| WO | WO-01/57273 | 8/2001 |
| WO | WO-01/57274 | 8/2001 |
| WO | WO-01/57275 | 8/2001 |
| WO | WO-01/57276 | 8/2001 |
| WO | WO-01/57277 | 8/2001 |
| WO | WO-01/57278 | 8/2001 |
| WO | WO-01/59063 | 8/2001 |
| WO | WO-01/60860 | 8/2001 |
| WO | WO-01/60999 | 8/2001 |
| WO | WO-01/62785 | 8/2001 |
| WO | WO-01/62927 | 8/2001 |
| WO | WO-01/63293 | 8/2001 |
| WO | WO-01/66719 | 9/2001 |
| WO | WO-01/68848 | 9/2001 |
| WO | WO-01/70976 | 9/2001 |
| WO | WO-01/71042 | 9/2001 |
| WO | WO-01/72777 | 10/2001 |
| WO | WO-01/73032 | 10/2001 |
| WO | WO-01/75067 | 10/2001 |
| WO | WO-01/77137 | 10/2001 |
| WO | WO-01/77290 | 10/2001 |
| WO | WO-01/77291 | 10/2001 |
| WO | WO-01/85177 | 11/2001 |
| WO | WO-01/86003 | 11/2001 |

| | | |
|---|---|---|
| WO | WO-01/87321 | 11/2001 |
| WO | WO-01/88188 | 11/2001 |
| WO | WO-01/92581 | 12/2001 |
| WO | WO-01/94629 | 12/2001 |
| WO | WO-01/96388 | 12/2001 |
| WO | WO-01/96390 | 12/2001 |
| WO | WO-02/00677 | 1/2002 |
| WO | WO-02/00927 | 1/2002 |
| WO | WO-02/08416 | 1/2002 |
| WO | WO-02/10449 | 2/2002 |
| WO | WO-02/12314 | 2/2002 |
| WO | WO-02/12328 | 2/2002 |
| WO | WO-02/12440 | 2/2002 |
| WO | WO-02/18424 | 3/2002 |
| WO | WO-02/18541 | 3/2002 |
| WO | WO-02/18632 | 3/2002 |
| WO | WO-02/24719 | 3/2002 |
| WO | WO-02/26936 | 4/2002 |
| WO | WO-02/28999 | 4/2002 |
| WO | WO-02/29086 | 4/2002 |
| WO | WO-02/29103 | 4/2002 |
| WO | WO-02/30268 | 4/2002 |
| WO | WO-02/31111 | 4/2002 |
| WO | WO-02/38759 | 5/2002 |
| WO | WO-02/41763 | 5/2002 |
| WO | WO-02/44331 | 6/2002 |
| WO | WO-02/46467 | 6/2002 |
| WO | WO-02/50301 | 6/2002 |
| WO | WO-02/052005 | 7/2002 |
| WO | WO-02/058534 | 8/2002 |
| WO | WO-02/059271 | 8/2002 |
| WO | WO-02/060317 | 8/2002 |
| WO | WO-02/064795 | 8/2002 |
| WO | WO-02/066064 | 8/2002 |
| WO | WO-02/069900 | 9/2002 |
| WO | WO-02/070539 | 9/2002 |
| WO | WO-02/077204 | 10/2002 |
| WO | WO-02/078516 | 10/2002 |
| WO | WO-02/079433 | 10/2002 |
| WO | WO-02/079449 | 10/2002 |
| WO | WO-02/083921 | 10/2002 |
| WO | WO-02/085298 | 10/2002 |
| WO | WO-02/090526 | 11/2002 |
| WO | WO-02/090992 | 11/2002 |
| WO | WO-02/095000 | 11/2002 |
| WO | WO-02/097031 | 12/2002 |
| WO | WO-02/097090 | 12/2002 |
| WO | WO-02/102982 | 12/2002 |
| WO | WO-03/012082 | 2/2003 |
| WO | WO-03/016549 | 2/2003 |
| WO | WO-03/022300 | 4/2003 |
| WO | WO-03/045989 | 6/2003 |

OTHER PUBLICATIONS

Boon, 1992 (Adv Can Res, 58:177-210).*
Bodey et al, 2000, Anticancer Res, 20: 2665-2676.*
Lee et al, 1999, J Immunol, 163: 6292-6300.*
Database EMBL, (2000) EBI Accession No. EMBL:BF674714.
Hubert et al., PNAS (1999) 96(25):14523-14528.
Nupponen et al., Amer. J. of Pathol. (1999) 154(6):1777-1783.
Porkka et al., J. of Pathol. (2001) 193(1):73-79.
Supplementary Partial European Search Report, Date Mailed on Apr. 18, 2007, for EP 02747813.0, 9 pages.
Alberts et al., Molecular Biology of the Cell, 3rd edition (1994) p. 465.
Boon, "Toward a genetic analysis of tumor rejection antigens," Adv. Can. Res. (1992) 58:177-210.
Bowie et al., "Deciphering the Message in Protein Sequences: Tolerance to Amino Acid Substitutions," Science (1990) 257:1306-1310.
Brennan et al., "Cytokine Production in Culture by Cells Isolated from the Synovial Membrane," Journal of Autoimmunity (1989) (2 suppl.):177-186.
Carrere et al., "Immunoreactive pancreatic Reg protein in sera from cystic fibrosis patients with and without pancreatic insufficiency," Gut (1999) 44:545-551.
Chaux et al., "Estimation of the frequencies of anti-mage-3 cytolytic t-lymphocyte precursors in blood from individuals without cancer," Int. J. Cancer (1998) 77:538-542.
Eriksson et al., "Insulin resistance in Type 2 (non-insulin-dependent) diabetic patients and their relatives is not associated with a defect in the expression of the insulin-responsive glucose transporter (GLUT-4) gene in human skeletal muscle," Diabetologia (1992) 35:143-147.
Ezzell, "Cancer "Vaccines": An Idea Whose Time Has Come?" J. NIH Res. (1995) 7:46-49.
Fu et al., Translational regulation of human p53 gene, EMBO Journal (1996) 15:4392-4401.
Greenbaum et al., "Comparing protein abundance and mRNA expression levels on a genomic scale," Genome Biology (2003) 4(9):117.1-117.8.
Greenspan et al., "Defining epitopes: It's not as easy as it seems," Nature Biotechnology (1999) 7:936-937.
Guo et al., "Induction Profile of Rat Organic Anion Transporting Polypeptide 2 (oatp2) by Prototypical Drug-Metabolizing Enzyme Inducers That Activate Gene Expression through Ligand-Activated Transcription Factor Pathways," Journal of Pharmacology and Experimental Therapeutics (2002) 300:206-212.
Gura, "Systems for Identifying New Drugs Are Often Faulty," Science (1997) 278:1041-1042.
Hell et al., "Hodgkin Cells Accumulate mRNA for *bcl-2*," Laboratory Investigation (1995) 73:492-496.
Herbert et al., The Dictionary of Immunology, Academic Press, 3rd edition, London (1985) pp. 58-59.
Holmes, "PSMA specific antibodies and their diagnostic and therapeutic use," Exp. Opin. Invest. Drugs (2001) 10(3):511-519.
Jang et al., "An examination of the effects of hypoxia, acidosis, and glucose starvation on the expression of metastasis-associated genes in murine tumor cells," Clinical and Experimental Metastasis (1997) 15:469-483.
Jansen et al., "Translational Control of Gene Expression," Pediatric Res. (1995) 37(6):681-686.
Kirkin et al., "Melanoma-associated antigens recognized by cytotoxic T lymphocytes," APMIS (1998) 106:665-679.
McClean and Hill, Evidence of Post-translational Regulation of P-Glycoprotein Associated with the Expression of a Distinctive Multiple Drug-resistant Phenotype in Chinese Hamster Ovary Cells, Eur. J. of Cancer (1993) 29A:2243-2248.
Powell et al., "Expression of cytochrome P4502E1 in human liver: assessment by mRNA, genotype and phenotype," Pharmacogenesis (1998) 8:411-421.
Roitt et al., Immunology 4th edition, Mosby, London (1993) pp. 7.7-7.8.
Shantz and Pegg, "Translational regulation of omithine decarboxylase and other enzymes of the polyamine pathway," Int. J. of Biochem. and Cell Biol. (1999) 31:107-122.
Sherman et al., "Strategies for Tumor Elimination by Cytotoxic T Lymphocytes," Critical Reviews in Immunol. (1998) 18(1-2):47-54.
Smith, "Cancer and the Immune System," Clin. Immunol. (1994) 41(4):841-849.
Spitler, "Cancer Vaccines: The Interferon Analogy," Cancer Biotherapy (1995) 10:1-3.
Vallejo et al., "Evidence of tissue-specific, post-transcriptional regulation of NRF-2 expression," Biochimie (2000) 82:1129-1133.
Zimmer, "Examination of the Calcium-Modulated Protein S100α and Its Target Proteins in Adult and Developing Skeletal Muscle," Cell Motility and the Cytoskeleton (1991) 20:325-337.
Boller et al., J. Virol. (1997) 17:4581-4588.
Danilczyk et al., Nature (2006) 444(7122):1088-1091.
Database EMBL, (2000) EBI accession No. EMBL:AW365784.
Database Geneseq, (1998) EBI accession No. GSN:AAV40540.
Database Geneseq, (2000) EBI accession No. GSP:AAB24430.

Database Geneseq, (2001) EBI accession No. GSN:AAH72870.
Database Geneseq, (2003) EBI accession No. GSP:ABB84525.
Database Geneseq, (2004) EBI accession No. GSP:ADK41492.
Partial European Search Report for EP 02747813.0, mailed Jul. 31, 2007, 13 pages.
Smogorzewska et al., Cell (2007) 129(2):289-301.
Zhang et al., The Journal of Biological Chemistry (2001) 276(20):17132-17139.
Office Action for Canadian Patent Application No. 2,443,123, mailed on Mar. 18, 2009, 4 pages.

* cited by examiner

Figure 1:

Figure 1A 74P3B3 SSH sequence of 217 nucleotides. (SEQ ID NO:1)

```
  1 GATCATCCGG AGTGGCCGCC TCCAATAAAG CAATGTAGCT TGGAGCCTTG GAGGTCTGAA
 61 TCTCAAATTT GCCCTGTTTC ACGAATGAAT GAATTGTGGC CTCAGGAACC ACGAGCGCAT
121 GGTGTAGCAC CAGTACAACA TAAGGCTGCA CTGCCATCTA ATGTTAATGA ATCGCCATTA
181 CAGTTTACTA TTCGGCAGGC TAGATTAGCC GGAGATC
```

Figure 1B 83P4B8 SSH sequence of 398 nucleotides. (SEQ ID NO:2)

```
  1 GATCAAGCAC CTGGTCCTGA AATCTTTGTA TTCTTGTTAC AGACAGAAGA AGAGCAATGC
 61 TGAAGGGACT TAAGTTATTA TTGGAATCTC CTTGCTGTCC TACCTTTAAG TGTTTCACGA
121 GTTCTCTGCC TAGTTCATAG TCCAATTTGA TGGCAAACAC AATGTGTAGA ATAATGGTGC
181 CTTCCACATG ACGAAGTTCA CCTGATGGCA CAGTGACAAC ATCCAATAGC TCGTCACCAC
241 TCTGTTCCTC ATTGNGCTGC TTATCTAGTG CACTGAAGAA GGCTATGATT CCTTNCAAAA
301 CACTCTTTNT GCTTCCTTGG AGGAGAGAAC CAGAAGCTGA TANACCAAAG GNGGTATTTC
361 TTGAAGATTC ATCTTGGAGA ACAAGCTCAA TGCTTTTT
```

Figure 1C 109P1D4 SSH sequence of 192 nucleotides. (SEQ ID NO:3)

```
  1 GATCCTGGTT GCAGCTGTTG CTGGCACCAT AACTGTCGTT GTAGTTATTT TCATCACTGC
 61 TGTAGTAAGA TGTCGCCAGG CACACACCTT AAGGCTGCTC AGAAAAACAT GCAGAATTCT
121 GAATGGGCTA CCCCAAACCC AGAAAACAGG CAGATGATAA AAAAAAAAAA AAAAAAAAAA
181 AAAAGCTTGA TC
```

Figure 1D 151P1C7A SSH sequence of 237 nucleotides. (SEQ ID NO:4)

```
  1 GATCTTGGAC CAGAAGTGTC TAGCACAACA CAATCCTGAG GCACAGTCTG ATGACCGGAG
 61 ACAAACAGAA CCTTCTTGTC CTTTGGTGTG ATACATTTTT GAAGACAAGG TGGTTCTTCT
121 GGAATACCCA TCCAAGGTGC TATGATCACG GGGCCCTTGT GGAATAAAGG CCGGTGGTTC
181 TCCTCATGCT TGTCCAGGCA GTTGGGATGC ACAGCATGGG CCATGTCTGC GCTGATC
```

Figure 1E 151P4E11 SSH sequence of 265 nucleotides. (SEQ ID NO:5)

```
  1 GATCTNCCCG CCGCAGCCTC CTCAGAAGAC ATCGAGCGGT CCTGAGAGCC TCCTGGGCAC
 61 GTTTGTCTGT GTGCTGTAAC CTGAAGTCAA ACCTTAAGAT AATGGATAAT CTTCGGCCAA
121 TTTATGCAGA GTCAGCCATT CCTGTTCTCT TTGCCTTGAT GTTGTGTTGT TATCATTNAA
181 GATNTTTTTT ATGGTAATTA TTTTGAGTGG CAAAATAAAG AATAGCANTT AAANAAAANA
241 NAAAAAAAAN ANAAANCGCT TGATC
```

Figure 1F 154P2A8 SSH sequence of 267 nucleotides. (SEQ ID NO:6)

```
  1 GATCCAGGCA AACATTACAC GCAGACAAGA AAAGTGTAAT TTCTTTGCAG TAATATAGGA
 61 TTTTTTGTGC AGATTCATCT AAAAGCCTGT CTAAGTGACT AAAAGTAAAA GGAATTCTGC
121 ACAAGTGATA TGGTAGAAAG CAGGTAAAAA ACACAGCCAC AACAACCCTG ATGCTCTGGT
181 TATGTTTTCG CTTTCGGCTT GACTGACTTA TGAATTGCCT GCTGGATTTG TGGATGTACC
241 TGGATATGGC TATGTAACAT CCCGATC
```

Figure 1G 156P1D4 SSH sequence of 212 nucleotides. (SEQ ID NO:7)

```
  1 GATCATATAT TTTGTTTCAC CATTCTTCTT TTGTAATAAA TTTTGAATGT GCTTGAAAGT
 61 GAAAAGCAAT CAATTATACC CACCAACACC ACTGAAATCA TAAGCTATTC ACGACTCAAA
121 ATATTCTAAA ATATTTTTCT GACAGTATAG TGTATAAATG TGGTCATGTG GTATTTGTAG
181 TTATTGATTT AAGCATTTTT AGAAATAAGA TC
```

Figure 1H 156P5C12 SSH sequence of 199 nucleotides. (SEQ ID NO:8)

```
  1 GATCTCTTTC TGTGTGTATT GGTCAGAATA GAATCCATTC AGCTGTAGCA GCAAGCAATC
 61 CCCAACCTTT CACTGCAATG ACCTTTCAAT GCAATAAAAG CTTATTGTCC ATTCAAAAAA
121 AAAAAAAAAA AAAAAAAAAA AAAAAAAAAA AAAAAAAAAA AAAAAAAAAA AAAAAAAAAA
181 AAAAAAAAAA GGNTTGATC
```

Figure 1I 159P2B5 SSH sequence of 110 nucleotides. (SEQ ID NO:9)

```
  1 GATCCTTGGC CCTCTAGGNA AGTANGTNAG NGCCCCAAGA CTGGANCTGG TCTCTTTCAA
 61 CGCCTTGGGA GACTGGGTGA AAGGCNAGCT TGNTTACGCT TAAAATGATC
```

Figure 1J 161P2B7A SSH sequence of 65 nucleotides. (SEQ ID NO:10)

```
  1 GATCAATTGA ATGAAAATAT CGTTTCAAAA AACAAAAAAA AAAAAAAAAA AAAAAAGGCT
 61 TGATC
```

Figure 1K 179P3G7 SSH sequence of 365 nucleotides. (SEQ ID NO:11)

```
  1 GATCTTAACT TTGCATGGAG AACAGAATGC TGTGTGTGAG TGCGTGGGTG AGTGAGGGTT
 61 TGACACACAC ACCAGCCACA CTCCCACCCC CATCTATGAG GGCACACACC ACACCCCACA
121 TCCCGGCACC CCATTTCTCA TGCTTTAAGT GGAAGCATCT TCGCAGCACG AACCACAGGT
181 CCCTTGGAAG GAGAGTCTGA GGTCTTTGCC TTTTTTGCAG TCGCATTGCA TTTATACTCA
241 GGGAGGAAAA AAAAATATAT CACCAGGCAC AAAGGGAGGA GGGGCGGGGA GAGGAAGGAG
301 CGGGAAGGGA GGAGGAGAGG CCGCGCTCTC AGGTGAAATT AAAATTGGAG GTCAGTTCCC
361 GGATC
```

Figure 1L 184P3C10B SSH sequence of 296 nucleotides. (SEQ ID NO:12)

```
  1 GATCATCAAG TTGTATAGCT GTATCATTGG CAACATGATT TCGCTGTTTC AGATAGAGAG
 61 CCTTGCCCGG GAGGCCTCCA CTGGAGTACT AAAAGACCTA ATGCATGGCC TCATCACCTT
121 AATGCTGGAT TCTCGGATTG AAGATCATTC CAGCCCCAGT GCTGTTCTCT GAATTCTTGG
181 GGAACACAGG GATGGGGGCT CCTAATGAGG ACCCCAGAAA CTCTGAGCTC TCACAACTTT
241 CAAAGGACAC TTGCCTCCCT CCTCTGCCCA CACCTCCACC ATTACAGCAT TTGATC
```

Figure 1M 184P3G10 SSH sequence of 406 nucleotides. (SEQ ID NO:13)

```
  1 GATCTCTGAA CTCCTGGGCT GAGGATGATT TGCTCCCTGC TGTAGAATCT GCCATTCCTT
 61 CCCTTAGCTG GTTCAGAAGG TCTCTGCTCT CACTGGGAGG CAAGTTACTC AGGAAGTATG
121 GAGGGGCCAA TTCCACCAGC ATCTGTGGTT GAATCTCAGA AACAATGGAA AGGCAGTTGT
181 CTTTGGATAT GGTGAAATTG TGGTAGAGCA CCCATGGTGG GGGTCTGGCA GGAGCTCTGC
241 GGCTTCGGTA GCAGCAGTAT GAGGAGAGCT GGGCCACATG CTTATGGGTT AGGAGAAGGT
301 AATTTCCAGT CCCGTCTGTG TCTCTGGCCA CCTTGAGAAA GTATCCTGAC ACCAGTGCTT
361 TCTGAAGGTC TCTGCGATTC TGCTCAGAGC CAAAGGCTGG TAGGGA
```

Figure 1N 185P2C9 SSH sequence of 163 nucleotides. (SEQ ID NO:14)

```
  1 GATCCTTATA TTATCCTACT TGGCTTGCAC GTCTTCGGGT GCATGTATAT ACCGCTACTG
 61 TGTCCTCGCC ATCACCTAAA TGTGACTCAG TCTGTTCCAC TGTAATATGT TGTGAATTTC
121 CTTGTACTGT ACTTTTATTG TTGGTCTTCT TGCATCGATG ATC
```

Figure 1(O) 185P3C2 SSH sequence of 287 nucleotides. (SEQ ID NO:15)

```
  1 GATCTGGGGA GCTCAGTGAA CCTCCTCACC CTCCTGCCAG TATGAAGTTG GGAAGCGCCT
 61 TCTCTGTCCC CCAGAACAGA ACAAACTCTT GTTCCCTGTG GTTGGGGAAA AGGTGTGGGG
121 GGCTTGGACC TAGGAAGAAG CTGAGCTGAA TTCCTCCAGG GCCCAGGTGA AACCCCCAGG
181 GGAGTTTCTG AGACTCTAGA CTTGCCATTT CTCCACTTTT CCTTCCCAAT GACTCCGGTG
241 AGCAGCTCAN AGTCTGGGCT AGGGCAACTG GTAGGACAGT GGGGATC
```

Figure 1P 186P1H9 SSH sequence of 210 nucleotides. (SEQ ID NO:16)

```
  1 GATCTCCGGT CCCTTCCCCC ATCATCCTTC CTTAGACTGA TGCTTTGACT GAATCATCAC
 61 TAGCTATGGC ATTAAAAGGC CTCTCTTCTC ATCTGGTGCC AAAGGTTCCG TTGCAGCTTT
121 TTACAACCAT CCGGTGTGGT TTGGAGGATT TGTTTTTTTT TTTCCCAACA NAAAGGAACA
181 GCCATTANAA GAAGGCTCCC ATTTTCTGAT
```

Figure 1Q 187P3F2 SSH sequence of 227 nucleotides. (SEQ ID NO:17)

```
  1 GATCTCGTTC ATACTGTGGT GGTGTTTCGT TTTTGTTTTT GTTTTTAAAG AAGGGTGAAG
 61 ATGCCTGACG CACGAAAACT GCACTCGTGA GGTTTTTCCA CCCTGAGATG ACCTACACGG
121 CAGCGGTGGA CAGCACCTGC CTCGTCTTCT CCTCTTTGAA AAAAAGAGAG AGAGAGAGTC
181 CCCTTTCCTT TCACTTTCTC CCTCCAAAAC AGCTGCCTAA AGAGATC
```

Figure 1R 192P2G7 SSH sequence of 381 nucleotides. (SEQ ID NO:18)

```
  1 GATCTTTCTA CCATTCGGGC GTGGCTCGCT CCTGATTCCC CTTGGAAATG AACTTTTATT
 61 TGGTTTACTG ACATTTATGT AGATTTCCAG TGAAAAGCTC TATAAAATAC AATAAATAAT
121 ACGGGGTTGA AAAGGCAGAC ATTCTAGTTG CATATATTAC AGGCTTTATC CTTACGGTCC
181 AGGCCATTGG AACTGCAATG TGGAGACTGT TTGTAATCAG ACATGGAAAG GCTGCACGTT
241 CTAAAGGCGA GACAGCTGCT TTCGGTTGGG AATCATCACA CTCCCTCCGC TCACGCCGCT
301 CTTCCCTTCC CCCGCTGTTT CACACGCTGC TTCCAGAGTT TGTCCAGCAA GGAATAAATG
361 AATGCATACA GGACTTTTGG C
```

Figure 2:

Figure 2A.1 The cDNA (SEQ ID NO:19) and amino acid sequence (SEQ ID NO:20) of 74P3B3 v.1A clone B. The start methionine is underlined. The open reading frame extends from nucleic acid 289-831 including the stop codon.

```
   1 ctccacgttgcgatggatccttggacccactttgttaactcttaaactttgtgtctttg
  61 tctttatttctttctcattccctcgtctccaccgggaaggggagagcctgcgggtggtg
 121 tatcaggcaggttcccctacatctttggcacccaacacggtctcctcgaacccaggtgaa
 181 gttacacctgagcgtggtcgttgtgaagaacggtctgtccaggaactcccgagaacgtgt
   1                                                 M  G  Q  S
 241 ggtcggccttgcggtaagcttgtgcactcggagcattccagggacaccATGGGACAATCC
   5 K  S  K  H  S  A  Y  L  H  F  I  K  L  L  L  K  R  A  G  I
 301 AAAAGTAAACATTCTGCATATTTACATTTTATTAAGCTCCTCTTAAAGAGGGCAGGAATT
  25 K  A  S  T  E  N  L  I  T  L  F  P  T  V  E  Q  Y  C  P  W
 361 AAGGCTAGCACAGAAAATTTGATTACTCTGTTTCCAACAGTAGAGCAATATTGTCCTTGG
  45 F  P  E  H  G  T  M  D  F  K  D  W  E  Q  V  G  I  A  L  K
 421 TTTCCTGAACATGGTACCATGGACTTCAAAGATTGGGAACAGGTGGGAATTGCCTTAAAA
  65 Q  V  C  K  E  G  K  F  I  P  L  T  A  W  S  N  W  A  I  V
 481 CAAGTTTGTAAGGAAGGAAAATTTATCCCCCTAACAGCCTGGTCAAACTGGGCTATAGTT
  85 K  A  A  S  E  P  F  Q  S  E  N  E  A  Y  P  P  A  E  K  I
 541 AAAGCAGCCTCGGAACCGTTTCAATCGGAAAATGAGGCTTATCCTCCAGCAGAAAGAATT
 105 S  A  E  E  G  G  D  A  A  E  G  G  E  D  S  E  E  D  F  E
 601 TCTGCAGAGGAAGGTGGTGATGCTGCTGAAGGAGGAGAGGATAGTGAAGAAGATTTTGAG
 125 E  N  T  D  K  P  G  D  E  L  I  S  F  E  E  H  V  G  P  S
 661 GAAAATACAGACAAACCTGGAGATGAGTTAATTTCTTTTGAGGAGCACGTGGGACCTTCA
 145 A  A  P  K  I  E  K  P  Y  M  P  R  C  L  K  Q  R  R  A  L
 721 GCTGCTCCTAAAATAGAGAAGCCATATATGCCAAGATGTTTAAAACAAAGAAGGGCCTTG
 165 R  S  S  R  L  L  I  G  I  I  R  S  G  R  L  Q  *
 781 AGGAGCAGTCGGCTCCTCATTGGGATCATCCGGAGTGGCCGCCTCCAATAAagcaatgta
 841 gcttggagccttggaggtctgaatctcaaatttgccctgtttcacgaatgaatgaattgt
 901 ggcctcaggaaccacaagcgcatggtgtagcaccagtacaacataaggctgcactgccat
 961 ctaatgttaatgaatcgccattacagtttattattcggcaggctagattagccggagatc
1021 ttgatgcctggcagtttgcagtagttttgcaacccccacgacagcaaggtggagcccatc
1081 aagcggtatgggaaccatttcttttaagctgctcaaagatcttaaagcagctgttggtc
1141 agtatggtcccaattcgcctttcatccgatcgctattgcaatctgtggctcagaataagc
1201 tattgactccgtgtgattgggagattttaacgaaagttacactttcgccctcccaatttc
1261 ttcagtttaagacttggtggaccgacgaggctcaaaatcaagatcgaaaaaaccgtgctg
1321 ctaatcctgctattgccattacatttgaacaacttctaggaataggggtcaatggggaa
1381 ctgtaaacaaccatcaggacttcgagatgatgccattgaacaaattcgcaattgctgttt
1441 gagggcatgggagaaaattcaggatctgggaactacttatcagtcttttaattctattag
1501 acaaggctcaaaggaaccatatcctgatttcattgctcgccttcaagacgcagcacagaa
1561 ggctctcactgatgaaagtgccaggaaggccgggtgcggtggctcatgcctgtaatccca
1621 gcactttgggaggccgaggtgggcggatcacctgaggtcgggagttggagaccagcctga
1681 ccaacatggagaaaccccgtctctactaaaaatataaaaattagccgggcgtgatggcac
1741 atgtctgtaatcccagctactcaggaggctgaggcaggagaattgcttgaacccaggagg
1801 cggaggttgcggtgagccgagatcacgccactgcactccagcctgggtaacaagagcgaa
1861 actccgcctcaaaaaaaaaaaaaaaaaaaaaaaaaaaaaaaaaa
```

Figure 2A.2. The cDNA (SEQ ID NO:21) and amino acid sequence (SEQ ID NO:22) of 74P3B3 v.1B clone B. The start methionine is underlined. The open reading frame extends from nucleic acid 756-1442 including the stop codon.

```
   1 ctccacgttgcgatggatccttggacccactttgttaactcttaaactttgtgtctttg
  61 tctttatttcttttctcattccctcgtctccaccgggaaggggagagcctgcgggtggtg
 121 tatcaggcaggttcccctacatctttggcacccaacacggtctcctcgaacccaggtgaa
 181 gttacacctgagcgtggtcgttgtgaagaacggtctgtccaggaactcccgagaacgtgt
 241 ggtcggccttgcggtaagcttgtgcactcggagcattccagggacaccatgggacaatcc
 301 aaaagtaaacattctgcatatttacattttattaagctcctcttaaagagggcaggaatt
 361 aaggctagcacagaaaatttgattactctgtttccaacagtagagcaatattgtccttgg
 421 tttcctgaacatggtaccatggacttcaaagattgggaacaggtgggaattgccttaaaa
 481 caagtttgtaaggaaggaaaatttatcccccctaacagcctggtcaaactgggctatagtt
 541 aaagcagcctcggaaccgtttcaatcggaaaatgaggcttatcctccagcagaaagaatt
 601 tctgcagaggaaggtggtgatgctgctgaaggaggagaggatagtgaagaagatttgag
 661 gaaaatacagacaaacctggagatgagttaatttcttttgaggagcacgtgggaccttca
   1                                     M  F  K  T  K  K  G  L  E
 721 gctgctcctaaaatagagaagccatatatgccaagATGTTTAAAACAAAGAAGGGCCTTG
  10  E  Q  S  A  P  H  W  D  H  P  E  W  P  P  P  I  K  Q  C  S
 781 AGGAGCAGTCGGCTCCTCATTGGGATCATCCGGAGTGGCCGCCTCCAATAAAGCAATGTA
  30  L  E  P  W  R  S  E  S  Q  I  C  P  V  S  R  M  N  E  L  W
 841 GCTTGGAGCCTTGGAGGTCTGAATCTCAAATTTGCCCTGTTTCACGAATGAATGAATTGT
  50  P  Q  E  P  Q  A  H  G  V  A  P  V  Q  H  K  A  A  L  P  S
 901 GGCCTCAGGAACCACAAGCGCATGGTGTAGCACCAGTACAACATAAGGCTGCACTGCCAT
  70  N  V  N  E  S  P  L  Q  F  I  I  R  Q  A  R  L  A  G  D  L
 961 CTAATGTTAATGAATCGCCATTACAGTTTATTATTCGGCAGGCTAGATTAGCCGGAGATC
  90  D  A  W  Q  F  A  V  V  L  Q  P  P  R  Q  Q  G  G  A  H  Q
1021 TTGATGCCTGGCAGTTTGCAGTAGTTTTGCAACCCCCACGACAGCAAGGTGGAGCCCATC
 110  A  V  W  E  P  F  S  F  K  L  L  K  D  L  K  A  A  V  G  Q
1081 AAGCGGTATGGGAACCATTTTCTTTTAAGCTGCTCAAAGATCTTAAAGCAGCTGTTGGTC
 130  Y  G  P  N  S  P  F  I  R  S  L  L  Q  S  V  A  Q  N  K  L
1141 AGTATGGTCCCAATTCGCCTTTCATCCGATCGCTATTGCAATCTGTGGCTCAGAATAAGC
 150  L  T  P  C  D  W  E  I  L  T  K  V  T  L  S  P  S  Q  F  L
1201 TATTGACTCCGTGTGATTGGGAGATTTTAACGAAAGTTACACTTTCGCCCTCCCAATTTC
 170  Q  F  K  T  W  W  T  D  E  A  Q  N  Q  D  R  K  N  R  A  A
1261 TTCAGTTTAAGACTTGGTGGACCGACGAGGCTCAAAATCAAGATCGAAAAAACCGTGCTG
 190  N  P  A  I  A  I  T  F  E  Q  L  L  G  I  G  G  Q  W  G  T
1321 CTAATCCTGCTATTGCCATTACATTTGAACAACTTCTAGGAATAGGGGGTCAATGGGGAA
 210  V  N  N  H  Q  D  F  E  M  M  P  L  N  K  F  A  I  A  V  *
1381 CTGTAAACAACCATCAGGACTTCGAGATGATGCCATTGAACAAATTCGCAATTGCTGTTT
1441 GAgggcatgggagaaaattcaggatctgggaactacttatcagtcttttaattctattag
1501 acaaggctcaaaggaaccatatcctgatttcattgctcgccttcaagacgcagcacagaa
1561 ggctctcactgatgaaagtgccaggaaggccgggtgcggtggctcatgcctgtaatccca
1621 gcactttgggaggccgaggtgggcggatcacctgaggtcgggagttggagaccagcctga
1681 ccaacatggagaaaccccgtctctactaaaaatataaaaattagccgggcgtgatggcac
1741 atgtctgtaatcccagctactcaggaggctgaggcaggagaattgcttgaacccaggagg
1801 cggaggttgcggtgagccgagatcacgccactgcactccagcctgggtaacaagagcgaa
1861 actccgcctcaaaaaaaaaaaaaaaaaaaaaaaaaaaaa
```

Figure 2B The cDNA (SEQ ID NO:23) and amino acid sequence (SEQ ID NO:24) of 83P4B8 clone 83P4B8.4AD. The start methionine is underlined. The open reading frame extends from nucleic acid 25-4011 including the stop codon

```
   1                         M   D   Q   K   I   L   S   L   A   A   E   K
   1 cggagttctgtgatatgagcaacaATGGACCAGAAGATTTTATCTCTAGCAGCAGAAAAA
  13 T   A   D   K   L   Q   E   F   L   Q   T   L   R   E   G   D   L   T   N   L
  61 ACAGCAGACAAACTGCAAGAATTTCTTCAAACCCTGAGAGAAGGTGATTTGACTAATCTC
  33 L   Q   N   Q   A   V   K   G   K   V   A   G   A   L   L   R   A   I   F   K
 121 CTTCAGAATCAAGCAGTGAAAGGAAAAGTTGCTGGAGCACTCCTGAGAGCCATCTTCAAA
  53 G   S   P   C   S   E   E   A   G   T   L   R   R   R   K   I   Y   T   C   C
 181 GGTTCCCCCTGCTCTGAGGAAGCTGGAACACTTAGGAGACGTAAGATATACACTTGTTGT
  73 I   Q   L   V   E   S   G   D   L   Q   K   E   I   V   S   E   I   I   G   L
 241 ATCCAGTTGGTGGAATCGGGGGATTTGCAGAAAGAAATAGTGTCTGAGATCATAGGATTA
  93 L   M   L   E   A   H   H   F   P   G   P   L   L   V   E   L   A   N   E   F
 301 CTGATGCTGGAGGCTCACCATTTTCCAGGACCATTATTGGTTGAATTAGCCAATGAGTTT
 113 I   S   A   V   R   E   G   S   L   V   N   G   K   S   L   E   L   L   P   I
 361 ATTAGTGCTGTCAGAGAAGGCAGCCTAGTGAATGGAAAATCTTTGGAGTTACTACCTATC
 133 I   L   T   A   L   A   T   K   K   E   N   L   A   Y   G   K   G   V   L   S
 421 ATTCTCACTGCCCTGGCTACGAAAAAGGAAAATCTGGCTTATGGAAAAGGTGTACTGAGT
 153 G   E   E   C   K   K   Q   L   I   N   T   L   C   S   G   R   W   D   Q   Q
 481 GGGGAAGAATGTAAGAAACAGTTGATTAACACCCTGTGTTCTGGCAGGTGGGATCAGCAA
 173 Y   V   I   Q   H   T   S   M   F   K   D   V   P   L   T   A   E   E   V   E
 541 TATGTAATCCAACACACCTCCATGTTCAAGGATGTCCCTCTGACTGCAGAAGAGGTGGAA
 193 F   V   V   E   K   A   L   S   M   F   S   K   M   N   L   Q   E   I   P   P
 601 TTTGTGGTGGAAAAAGCATTGAGCATGTTCTCCAAGATGAATCTTCAAGAAATACCACCT
 213 L   V   Y   Q   L   L   V   L   S   S   K   G   S   R   K   S   V   L   E   G
 661 TTGGTCTATCAGCTTCTGGTTCTCTCCTCCAAGGGAAGCAGAAAGAGTGTTTTGGAAGGA
 233 I   I   A   F   F   S   A   L   D   K   Q   H   N   E   E   Q   S   G   D   E
 721 ATCATAGCCTTCTTCAGTGCACTAGATAAGCAGCACAATGAGGAACAGAGTGGTGACGAG
 253 L   L   D   V   V   T   V   P   S   G   E   L   R   H   V   E   G   T   I   I
 781 CTATTGGATGTTGTCACTGTGCCATCAGGTGAACTTCGTCATGTGGAAGGCACCATTATT
 273 L   H   I   V   F   A   I   K   L   D   Y   E   L   G   R   E   L   V   K   H
 841 CTACACATTGTGTTTGCCATCAAATTGGACTATGAACTAGGCAGAGAACTCGTGAAACAC
 293 L   K   V   G   Q   Q   G   D   S   N   N   N   L   S   P   F   S   I   A   L
 901 TTAAAGGTAGGACAGCAAGGAGATTCCAATAATAACTTAAGTCCCTTCAGCATTGCTCTT
 313 L   L   S   V   T   R   I   Q   R   F   Q   D   Q   V   L   D   L   L   K   T
 961 CTTCTGTCTGTAACAAGAATACAAAGATTTCAGGACCAGGTGCTTGATCTTTTAAAGACT
 333 S   V   V   K   S   F   K   D   L   Q   L   L   Q   G   S   K   F   L   Q   N
1021 TCGGTTGTAAAGAGCTTTAAGGATCTTCAACTCCTCCAAGGCTCAAAATTTCTTCAGAAT
 353 L   V   P   H   R   S   Y   V   S   T   M   I   L   E   V   V   K   N   S   V
1081 CTAGTTCCTCATAGATCTTATGTTTCAACCATGATCTTGGAAGTAGTGAAGAATAGCGTT
 373 H   S   W   D   H   V   T   Q   G   L   V   E   L   G   F   I   L   M   D   S
1141 CATAGCTGGGACCATGTTACTCAGGGCCTCGTAGAACTTGGTTTCATTTTGATGGATTCA
 393 Y   G   P   K   K   V   L   D   G   K   T   I   E   T   S   P   S   L   S   R
1201 TATGGGCCAAAGAAGGTTCTTGATGGAAAAACTATTGAAACCAGCCCAAGTCTTTCTAGA
 413 M   P   N   Q   H   A   C   K   L   G   A   N   I   L   L   E   T   F   K   I
1261 ATGCCAAACCAGCATGCATGTAAGCTCGGAGCTAATATCCTGTTGGAAACTTTTAAGATC
 433 H   E   M   I   R   Q   E   I   L   E   Q   V   L   N   R   V   V   T   R   A
1321 CATGAGATGATCAGACAAGAAATTTTGGAGCAGGTCCTCAACAGGGTTGTTACCAGAGCA
 453 S   S   P   I   S   H   F   L   D   L   L   S   N   I   V   M   Y   A   P   L
1381 TCTTCTCCCATCAGTCATTTCTTAGACCTGCTTTCAAATATCGTCATGTATGCACCCTTA
 473 V   L   Q   S   C   S   S   K   V   T   E   A   F   D   Y   L   S   F   L   P
1441 GTTCTTCAAAGTTGTTCTTCTAAAGTCACAGAAGCTTTTGACTATTTGTCCTTTCTGCCC
 493 L   Q   T   V   Q   R   L   L   K   A   V   Q   P   L   L   K   V   S   M   S
1501 CTTCAGACTGTACAAAGGCTGCTTAAGGCAGTGCAGCCCCTTCTCAAAGTCAGCATGTCA
 513 M   R   D   C   L   I   L   V   L   R   K   A   M   F   A   N   Q   L   D   A
1561 ATGAGAGACTGCTTGATACTTGTCCTTCGGAAAGCTATGTTTGCCAACCAGCTTGATGCC
 533 R   K   S   A   V   A   G   F   L   L   L   L   K   N   F   K   V   L   G   S
1621 CGAAAATCTGCAGTTGCTGGGTTTTTGCTGCTCCTGAAGAACTTTAAAGTTTTAGGCAGC
 553 L   S   S   S   Q   C   S   Q   S   L   S   V   S   Q   V   H   V   D   V   H
1681 CTGTCATCCTCTCAGTGCAGTCAGTCTCTCAGTGTCAGTCAGGTTCATGTGGATGTTCAC
 573 S   H   Y   N   S   V   A   N   E   T   F   C   L   E   I   M   D   S   L   R
1741 AGCCATTACAATTCTGTCGCCAATGAAACTTTTTGCCTTGAGATCATGGATAGTTTGAGG
 593 R   C   L   S   Q   Q   A   D   V   R   L   M   L   Y   E   G   F   Y   D   V
1801 AGATGCTTAAGCCAGCAAGCTGATGTTCGACTCATGCTTTATGAGGGGTTTTATGATGTT
 613 L   R   R   N   S   Q   L   A   N   S   V   M   Q   T   L   L   S   Q   L   K
1861 CTTCGAAGGAACTCTCAGCTGGCTAATTCAGTCATGCAAACTCTGCTCTCACAGTTAAAA
 633 Q   F   Y   E   P   K   P   D   L   L   P   P   L   K   L   D   A   C   I   L
1921 CAGTTCTATGAGCCAAAACCTGATCTGCTGCCTCCTCTGAAATTAGATGCTTGTATTCTG
 653 T   Q   G   D   K   I   S   L   Q   E   P   L   D   Y   L   L   C   C   I   Q
1981 ACCCAAGGAGATAAGATCTCTCTACAAGAACCACTGGATTATCTGCTGTGTTGTATTCAG
 673 H   C   L   A   W   Y   K   N   T   V   I   P   L   Q   Q   G   E   E   E   E
```

Figure 2B (continued)

2041 CATTGTTTGGCCTGGTATAAGAATACAGTCATACCCTTACAGCAGGGAGAGGAGGAAGAG
693 E E E E A F Y E D L D D I L E S I T N R
2101 GAGGAGGAAGAGGCATTCTACGAAGACCTAGATGATATATTGGAGTCCATTACTAATAGA
713 M I K S E L E D F E L D K S A D F S Q S
2161 ATGATTAAGAGTGAGCTGGAAGACTTTGAACTGGATAAATCAGCAGATTTTTCTCAGAGC
733 T S I G I K N N I S A F L V M G V C E V
2221 ACCAGTATTGGCATAAAAAATAATATCTCTGCTTTTCTTGTGATGGGAGTTTGTGAGGTT
753 L I E Y N F S I S S F S K N R F E D I L
2281 TTAATAGAATACAATTTCTCCATAAGTAGTTTCAGTAAGAATAGGTTTGAGGACATTCTG
773 S L F M C Y K K L S D I L N E K A G K A
2341 AGCTTATTTATGTGTTACAAAAAACTCTCTGACATTCTTAATGAAAAAGCGGGTAAAGCC
793 K T K M A N K T S D S L L S M K F V S S
2401 AAAACTAAAATGGCCAACAAGACAAGTGATAGTCTTTTGTCCATGAAATTTGTGTCCAGT
813 L L T A L F R D S I Q S H Q E S L S V L
2461 CTTCTCACTGCTCTTTTCAGGGATAGTATCCAAAGCCACCAAGAAAGCCTTTCTGTTCTC
833 R S S N E F M R Y A V N V A L Q K V Q Q
2521 AGGTCCAGCAATGAGTTTATGCGCTATGCAGTGAATGTAGCTCTGCAGAAAGTACAGCAG
853 L K E T G H V S G P D G Q N P E K I F Q
2581 CTAAAGGAAACAGGGCATGTGAGTGGCCCTGATGGCCAAAACCCAGAAAAGATCTTTCAG
873 N L C D I T R V L L W R Y T S I P T S V
2641 AACCTCTGTGACATAACTCGAGTCTTGCTATGGAGATACACTTCAATTCCTACTTCAGTG
893 E E S G K K E K G K S I S L L C L E G L
2701 GAAGAGTCGGGAAAGAAAGAGAAAGGAAAGAGCATCTCACTGCTGTGCTTGGAGGGTTTA
913 Q K I F S A V Q Q F Y Q P K I Q Q F L R
2761 CAGAAAATATTCAGTGCTGTGCAACAGTTCTATCAGCCCAAGATTCAGCAGTTTCTCAGA
933 A L D V T D K E G E E R E D A D V S V T
2821 GCTCTGGATGTCACAGATAAGGAAGGAGAAGAGAGAGAAGATGCAGATGTCAGTGTCACT
953 Q R T A F Q I R Q F Q R S L L N L L S S
2881 CAGAGAACAGCATTCCAGATCCGGCAATTTCAGAGGTCCTTGTTGAATTTACTTAGCAGT
973 Q E E D F N S K E A L L L V T V L T S L
2941 CAAGAGGAAGATTTTAATAGCAAAGAAGCCCTCCTGCTAGTCACGGTTCTTACCAGTTTG
993 S K L L E P S S P Q F V Q M L S W T S K
3001 TCCAAGTTACTGGAGCCCTCCTCTCCTCAGTTTGTGCAGATGTTATCCTGGACATCAAAG
1013 I C K E N S R E D A L F C K S L M N L L
3061 ATTTGCAAGGAAAACAGCCGGGAGGATGCCTTGTTTTGCAAGAGCTTGATGAACTTGCTC
1033 F S L H V S Y K S P V I L L R D L S Q D
3121 TTCAGCCTGCATGTTTCGTATAAGAGTCCTGTCATTCTGCTGCGTGACTTGTCCCAGGAT
1053 I H G H L G D I D Q D V E V E K T N H F
3181 ATCCACGGGCATCTGGGAGATATAGACCAGGATGTAGAGGTGGAGAAAACAAACCACTTT
1073 A I V N L R T A A P T V C L L V L S Q A
3241 GCAATAGTGAATTTGAGAACGGCTGCCCCCACTGTCTGTTTACTTGTTCTGAGTCAGGCC
1093 E K V L E E V D W L I T K L K G Q V S Q
3301 GAGAAGGTTCTAGAAGAAGTGGACTGGCTAATCACCAAGCTTAAGGGACAAGTGAGCCAA
1113 E T L S E E A S S Q A T L P N Q P V E K
3361 GAAACCTTATCAGAAGAGGCCTCTTCTCAGGCAACCCTACCAAATCAGCCTGTTGAGAAA
1133 A I I M Q L G T L L T F F H E L V Q T A
3421 GCTATCATCATGCAACTGGGAACTCTGCTTACATTTTTCCACGAGCTGGTGCAGACAGCT
1153 L P S G S C V D T L L K D L C K M Y T T
3481 CTGCCATCAGGCAGCTGTGTGGACACCTTGTTAAAGGACTTGTGCAAAATGTACACCACA
1173 L T A L V R Y Y L Q V C Q S S G G I P K
3541 CTTACAGCCCTTGTCAGATATTATCTCCAGGTGTGTCAGAGCTCCGGAGGAATCCCAAAA
1193 N M E K L V K L S G S H L T P L C Y S F
3601 AATATGGAAAAGCTGGTGAAGCTGTCTGGTTCTCATCTGACCCCCCTGTGTTATTCTTTC
1213 I S Y V Q N K S K S L N Y T G E K K E K
3661 ATTTCTTACGTACAGAATAAGAGTAAGAGCCTGAACTATACGGGAGAGAAAAAGGAGAAA
1233 P A A V A T A M A R V L R E T K P I P N
3721 CCTGCTGCCGTTGCCACAGCCATGGCCAGAGTTCTTCGGGAAACCAAGCCAATCCCTAAC
1253 L I F A I E Q Y E K F L I H L S K K S K
3781 CTCATCTTTGCCATAGAACAGTATGAAAAATTTCTCATCCACCTTTCTAAGAAGTCCAAG
1273 V N L M Q H M K L S T S R D F K I K G N
3841 GTGAACCTGATGCAGCACATGAAGCTCAGCACCTCACGAGACTTCAAGATCAAAGGAAAC
1293 I L D M V L R E D G E D E N E E G T A S
3901 ATCCTAGACATGGTTCTTCGAGAGGATGGCGAAGATGAAAATGAAGAGGGCACTGCATCA
1313 E H G G Q N K E P A K K K R K K *
3961 GAGCATGGGGGACAGAACAAAGAACCAGCCAAGAAGAAAAGGAAAAAATAAatgaaatgc
4021 ctgagttaatgtg

Figure 2C The cDNA (SEQ ID NO:25) and amino acid sequence (SEQ ID NO:26) of 109P1D4 clone 109P1D4.9AD. The start methionine is underlined. The open reading frame extends from nucleic acid 846-3911 including the stop codon

```
   1 ctggtggtccagtacctccaaagatatggaatacactcctgaaatatcctgaaaactttt
  61 tttttcagaatcctttaataagcagttatgtcaatctgaaagttgcttacttgtacttt
 121 atattaatagctattcttgtttttcttatccaaagaaaaatcctctaatcccctttcac
 181 atgatagttgttaccatgtttaggcattagtcacatcaacccctctcctctcccaaactt
 241 ctcttcttcaaatcaaactttattagtccctcctttataatgattccttgcctcgtttta
 301 tccagatcaatttttttcactttgatgcccagagctgaagaaatggactactgtataaa
 361 ttattcattgccaagagaataattgcatttaaacccatattataacaaagaataatgat
 421 tatattttgtgatttgtaacaaatacccttttattttcccttaactattgaattaaatatt
 481 ttaattatttgtattctctttaactatcttggtatattaaagtattatcttttatatatt
 541 tatcaatggtggacacttttataggtactctgtgtcatttttgatactgtaggtatctta
 601 tttcatttatctttattcttaatgtacgaattcataatatttgattcagaacaaatttat
 661 cactaattaacagagtgtcaattatgctaacatctcatttactgattttaatttaaaaca
 721 gtttttgttaacatgcatgtttagggttggcttcttaataatttcttcttcctcttctct
 781 ctctcctcttcttttggtcagtgttgtgcgggttaatacaacaaactgtaacaagtgtac
   1      M  D  L  L  S  G  T  Y  I  F  A  V  L  L  A  C  V  V  F
 841 ctggtATGGACTTGTTGTCCGGGACGTACATTTTCGCGGTCCTGCTAGCATGCGTGGTGT
  20  H  S  G  A  Q  E  K  N  Y  T  I  R  E  E  M  P  E  N  V  L
 901 TCCACTCTGGCGCCCAGGAGAAAAACTACACCATCCGAGAAGAAATGCCAGAAAACGTCC
  40  I  G  D  L  L  K  D  L  N  L  S  L  I  P  N  K  S  L  T  T
 961 TGATAGGCGACTTGTTGAAAGACCTTAACTTGTCGCTGATTCCAAACAAGTCCTTGACAA
  60  A  M  Q  F  K  L  V  Y  K  T  G  D  V  P  L  I  R  I  E  E
1021 CTGCTATGCAGTTCAAGCTAGTGTACAAGACCGGAGATGTGCCACTGATTCGAATTGAAG
  80  D  T  G  E  I  F  T  T  G  A  R  I  D  R  E  K  L  C  A  G
1081 AGGATACTGGTGAGATCTTCACTACTGGCGCTCGCATTGATCGTGAGAAATTATGTGCTG
 100  I  P  R  D  E  H  C  F  Y  E  V  E  V  A  I  L  P  D  E  I
1141 GTATCCCAAGGGATGAGCATTGCTTTTATGAAGTGGAGGTTGCCATTTTGCCGGATGAAA
 120  F  R  L  V  K  I  R  F  L  I  E  D  I  N  D  N  A  P  L  F
1201 TATTTAGACTGGTTAAGATACGTTTTCTGATAGAAGATATAAATGATAATGCACCATTGT
 140  P  A  T  V  I  N  I  S  I  P  E  N  S  A  I  N  S  K  Y  T
1261 TCCCAGCAACAGTTATCAACATATCAATTCCAGAGAACTCGGCTATAAACTCTAAATATA
 160  L  P  A  A  V  D  P  D  V  G  I  N  G  V  Q  N  Y  E  L  I
1321 CTCTCCCAGCGGCTGTTGATCCTGACGTAGGAATAAACGGAGTTCAAAACTACGAACTAA
 180  K  S  Q  N  I  F  G  L  D  V  I  E  T  P  E  G  D  K  M  P
1381 TTAAGAGTCAAAACATTTTTGGCCTCGATGTCATTGAAACACCAGAAGGAGACAAGATGC
 200  Q  L  I  V  Q  K  E  L  D  R  E  E  K  D  T  Y  V  M  K  V
1441 CACAACTGATTGTTCAAAAGGAGTTAGATAGGGAAGAGAAGGATACCTACGTGATGAAAG
 220  K  V  E  D  G  G  F  P  Q  R  S  S  T  A  I  L  Q  V  S  V
1501 TAAAGGTTGAAGATGGTGGCTTTCCTCAAAGATCCAGTACTGCTATTTTGCAAGTGAGTG
 240  T  D  T  N  D  N  H  P  V  F  K  E  T  E  I  E  V  S  I  P
1561 TTACTGATACAAATGACAACCACCCAGTCTTTAAGGAGACAGAGATTGAAGTCAGTATAC
 260  E  N  A  P  V  G  T  S  V  T  Q  L  H  A  T  D  A  D  I  G
1621 CAGAAAATGCTCCTGTAGGCACTTCAGTGACACAGCTCCATGCCACAGATGCTGACATAG
 280  E  N  A  K  I  H  F  S  F  S  N  L  V  S  N  I  A  R  R  L
1681 GTGAAAATGCCAAGATCCACTTCTCTTTCAGCAATCTAGTCTCCAACATTGCCAGGAGAT
 300  F  H  L  N  A  T  T  G  L  I  T  I  K  E  P  L  D  R  E  E
1741 TATTTCACCTCAATGCCACCACTGGACTTATCACAATCAAAGAACCACTGGATAGGGAAG
 320  T  P  N  H  K  L  L  V  L  A  S  D  G  G  L  M  P  A  R  A
1801 AAACACCAAACCACAAGTTACTGGTTTTGGCAAGTGATGGTGGATTGATGCCAGCAAGAG
 340  M  V  L  V  N  V  T  D  V  N  D  N  V  P  S  I  D  I  R  Y
1861 CAATGGTGCTGGTAAATGTTACAGATGTCAATGATAATGTCCCATCCATTGACATAAGAT
 360  I  V  N  P  V  N  D  T  V  V  L  S  E  N  I  P  L  N  T  K
1921 ACATCGTCAATCCTGTCAATGACACAGTTGTTCTTTCAGAAAATATTCCACTCAACACCA
 380  I  A  L  I  T  V  T  D  K  D  A  D  H  N  G  R  V  T  C  F
1981 AAATTGCTCTCATAACTGTGACGGATAAGGATGCGGACCATAATGGCAGGGTGACATGCT
 400  T  D  H  E  I  P  F  R  L  R  P  V  F  S  N  Q  F  L  L  E
2041 TCACAGATCATGAAATCCCTTTCAGATTAAGGCCAGTATTCAGTAATCAGTTCCTCCTGG
 420  T  A  A  Y  L  D  Y  E  S  T  K  E  Y  A  I  K  L  L  A  A
2101 AGACTGCAGCATATCTTGACTATGAGTCCACAAAAGAATATGCCATTAAATTACTGGCTG
 440  D  A  G  K  P  P  L  N  Q  S  A  M  L  F  I  K  V  K  D  E
2161 CAGATGCTGGCAAACCTCCTTTGAATCAGTCAGCAATGCTCTTCATCAAAGTGAAAGATG
 460  N  D  N  A  P  V  F  T  Q  S  F  V  T  V  S  I  P  E  N  N
2221 AAAATGACAATGCTCCAGTTTTCACCCAGTCTTTCGTAACTGTTTCTATTCCTGAGAATA
 480  S  P  G  I  Q  L  T  K  V  S  A  M  D  A  D  S  G  P  N  A
2281 ACTCTCCTGGCATCCAGTTGACGAAAGTAAGTGCAATGGATGCAGACAGTGGGCCTAATG
 500  K  I  N  Y  L  L  G  P  D  A  P  P  E  F  S  L  D  C  R  T
2341 CTAAGATCAATTACCTGCTAGGCCCTGATGCTCCACCTGAATTCAGCCTGGATTGTCGTA
 520  G  M  L  T  V  V  K  K  L  D  R  E  K  E  D  K  Y  L  F  T
2401 CAGGCATGCTGACTGTAGTGAAGAAACTAGATAGAGAAAAAGAGGATAAATATTTATTCA
```

Figure 2C (continued)

```
 540   I  L  A  K  D  N  G  V  P  P  L  T  S  N  V  T  V  F  V  S
2461 CAATTCTGGCAAAAGATAACGGGGTACCACCCTTAACCAGCAATGTCACAGTCTTTGTAA
 560   I  I  D  Q  N  D  N  S  P  V  F  T  H  N  E  Y  N  F  Y  V
2521 GCATTATTGATCAGAATGACAATAGCCCAGTTTTCACTCACAATGAATACAACTTCTATG
 580   P  E  N  L  P  R  H  G  T  V  G  L  I  T  V  T  D  P  D  Y
2581 TCCCAGAAAACCTTCCAAGGCATGGTACAGTAGGACTAATCACTGTAACTGATCCTGATT
 600   G  D  N  S  A  V  T  L  S  I  L  D  E  N  D  D  F  T  I  D
2641 ATGGAGACAATTCTGCAGTTACGCTCTCCATTTTAGATGAGAATGATGACTTCACCATTG
 620   S  Q  T  G  V  I  R  P  N  I  S  F  D  R  E  K  Q  E  S  Y
2701 ATTCACAAACTGGTGTCATCCGACCAAATATTTCATTTGATAGAGAAAAACAAGAATCTT
 640   T  F  Y  V  K  A  E  D  G  G  R  V  S  R  S  S  S  A  K  V
2761 ACACTTTCTATGTAAAGGCTGAGGATGGTGGTAGAGTATCACGTTCTTCAAGTGCCAAAG
 660   T  I  N  V  V  D  V  N  D  N  K  P  V  F  I  V  P  P  S  N
2821 TAACCATAAATGTGGTTGATGTCAATGACAACAAACCAGTTTTCATTGTCCCTCCTTCCA
 680   C  S  Y  E  L  V  L  P  S  T  N  P  G  T  V  V  F  Q  V  I
2881 ACTGTTCTTATGAATTGGTTCTACCGTCCACTAATCCAGGCACAGTGGTCTTTCAGGTAA
 700   A  V  D  N  D  T  G  M  N  A  E  V  C  Y  S  I  V  G  G  N
2941 TTGCTGTTGACAATGACACTGGCATGAATGCAGAGGTTTGTTACAGCATTGTAGGAGGAA
 720   T  R  D  L  F  A  I  D  Q  E  T  G  N  I  T  L  M  E  K  C
3001 ACACAAGAGATCTGTTTGCAATCGACCAAGAAACAGGCAACATAACATTGATGGAGAAAT
 740   D  V  T  D  L  G  L  H  R  V  L  V  K  A  N  D  L  G  Q  P
3061 GTGATGTTACAGACCTTGGTTTACACAGAGTGTTGGTCAAAGCTAATGACTTAGGACAGC
 760   D  S  L  F  S  V  V  I  V  N  L  F  V  N  E  S  V  T  N  A
3121 CTGATTCTCTCTTCAGTGTTGTAATTGTCAATCTGTTCGTGAATGAGTCGGTGACCAATG
 780   T  L  I  N  E  L  V  R  K  S  T  E  A  P  V  T  P  N  T  E
3181 CTACACTGATTAATGAACTGGTGCGCAAAAGCACTGAAGCACCAGTGACCCCAAATACTG
 800   I  A  D  V  S  S  P  T  S  D  Y  V  K  I  L  V  A  A  V  A
3241 AGATAGCTGATGTATCCTCACCAACTAGTGACTATGTCAAGATCCTGGTTGCAGCTGTTG
 820   G  T  I  T  V  V  V  V  I  F  I  T  A  V  V  R  C  R  Q  A
3301 CTGGCACCATAACTGTCGTTGTAGTTATTTTCATCACTGCTGTAGTAAGATGTCGCCAGG
 840   P  H  L  K  A  A  Q  K  N  K  Q  N  S  E  W  A  T  P  N  P
3361 CACCACACCTTAAGGCTGCTCAGAAAAACAAGCAGAATTCTGAATGGGCTACCCCAAACC
 860   E  N  R  Q  M  I  M  M  K  K  K  K  K  K  K  K  H  S  P  K
3421 CAGAAAACAGGCAGATGATAATGATGAAGAAAAAGAAAAAGAAGAAGAAGCATTCCCCTA
 880   N  L  L  L  N  F  V  T  I  E  E  T  K  A  D  D  V  D  S  D
3481 AGAACTTGCTGCTTAATTTTGTCACTATTGAAGAAACTAAGGCAGATGATGTTGACAGTG
 900   G  N  R  V  T  L  D  L  P  I  D  L  E  E  Q  T  M  G  K  Y
3541 ATGGAAACAGAGTCACACTAGACCTTCCTATTGATCTAGAAGAGCAAACAATGGGAAAGT
 920   N  W  V  T  T  P  T  T  F  K  P  D  S  P  D  L  A  R  H  Y
3601 ACAATTGGGTAACTACACCTACTACTTTCAAGCCCGACAGCCCTGATTTGGCCCGACACT
 940   K  S  A  S  P  Q  P  A  F  Q  I  Q  P  E  T  P  L  N  S  K
3661 ACAAATCTGCCTCTCCACAGCCTGCCTTCCAAATTCAGCCTGAAACTCCCCTGAATTCGA
 960   H  H  I  I  Q  E  L  P  L  D  N  T  F  V  A  C  D  S  I  S
3721 AGCACCACATCATCCAAGAACTGCCTCTCGATAACACCTTTGTGGCCTGTGACTCTATCT
 980   K  C  S  S  S  S  S  D  P  Y  S  V  S  D  C  G  Y  P  V  T
3781 CCAAGTGTTCCTCAAGCAGTTCAGATCCCTACAGCGTTTCTGACTGTGGCTATCCAGTGA
1000   T  F  E  V  P  V  S  V  H  T  R  P  V  G  I  Q  V  S  N  T
3841 CGACCTTCGAGGTACCTGTGTCCGTACACACCAGACCGGTAGGTATCCAAGTTTCTAACA
1020   T  F  *
3901 CAACTTTCTAActatttttttattattattttcagttgatgtagaactttacaaaatcta
3961 ttgacttcaaagagggatcaaaacaatcatattctacagatgtacccaatagatatatgg
4021 attcaattaagtttggtagaagatgagaacaaaataactactgatttaggaaaattggat
4081 gcagaataataattatagtaggggcaattttgtctgtagatggcagtatgacaattcttg
4141 ctagagaatatattgaaaaaaacttcaacacaaagggttgtagcactgtcctcagtacca
4201 ttgtgtgcatgaggatcagaatagtctgggctagatacatcacattaaagcttttcagaa
4261 tctgataaatagctctaaatactaatgatattgagaagcctagcttcacttgggaaaatc
4321 tgtggctgttcacagaaattcagcaccaagttattccccccatactctaccaggccttca
4381 ggtcctcataaagaaaagtgtcgttttcagattaggaactcaaaattatttggtgcatc
4441 aaatctacagtcacacaatataacaagaatgggattagaaaaatgaaagcctactcattc
4501 tcatctttaagccagagaatgaaatatatatgaggtctctggatagctatttaaatattt
4561 gcatatttatgcaaggtattttgagcccttcagaagacattct
```

Figure 2D The cDNA (SEQ ID NO:27) and amino acid sequence (SEQ ID NO:28) of 151P1C7A. The start methionine is underlined. The open reading frame extends from nucleic acid 103-903 including the stop codon.

```
   1 ccacgcgtccgcggacgcgtgggcggcacggtttcgtggggacccaggcttgcaaagtga
   1                                           M  M  A  L  G  A
  61 cggtcattttctctttctttctccctcttgagtccttctgagATGATGGCTCTGGGCGCA
   7 A  G  A  T  R  V  F  V  A  M  V  A  A  A  L  G  G  H  P  L
 121 GCGGGAGCTACCCGGGTCTTTGTCGCGATGGTAGCGGCGGCTCTCGGCGGCCACCCTCTG
  27 L  G  V  S  A  T  L  N  S  V  L  N  S  N  A  I  K  N  L  P
 181 CTGGGAGTGAGCGCCACCTTGAACTCGGTTCTCAATTCCAACGCTATCAAGAACCTGCCC
  47 P  P  L  G  G  A  A  G  H  P  G  S  A  V  S  A  A  P  G  I
 241 CCACCGCTGGGCGGCGCTGCGGGGCACCCAGGCTCTGCAGTCAGCGCCGCGCCGGGAATC
  67 L  Y  P  G  G  N  K  Y  Q  T  I  D  N  Y  Q  P  Y  P  C  A
 301 CTGTACCCGGGCGGGAATAAGTACCAGACCATTGACAACTACCAGCCGTACCCGTGCGCA
  87 E  D  E  E  C  G  T  D  E  Y  C  A  S  P  T  R  G  G  D  A
 361 GAGGACGAGGAGTGCGGCACTGATGAGTACTGCGCTAGTCCCACCCGCGGAGGGGACGCA
 107 G  V  Q  I  C  L  A  C  R  K  R  R  K  R  C  M  R  H  A  M
 421 GGCGTGCAAATCTGTCTCGCCTGCAGGAAGCGCCGAAAACGCTGCATGCGTCACGCTATG
 127 C  C  P  G  N  Y  C  K  N  G  I  C  V  S  S  D  Q  N  H  F
 481 TGCTGCCCCGGGAATTACTGCAAAAATGGAATATGTGTGTCTTCTGATCAAAATCATTTC
 147 R  G  E  I  E  E  T  I  T  E  S  F  G  N  D  H  S  T  L  D
 541 CGAGGAGAAATTGAGGAAACCATCACTGAAAGCTTTGGTAATGATCATAGCACCTTGGAT
 167 G  Y  S  R  R  T  T  L  S  S  K  M  Y  H  T  K  G  Q  E  G
 601 GGGTATTCCAGAAGAACCACCTTGTCTTCAAAAATGTATCACACCAAAGGACAAGAAGGT
 187 S  V  C  L  R  S  S  D  C  A  S  G  L  C  C  A  R  H  F  W
 661 TCTGTTTGTCTCCGGTCATCAGACTGTGCCTCAGGATTGTGTTGTGCTAGACACTTCTGG
 207 S  K  I  C  K  P  V  L  K  E  G  Q  V  C  T  K  H  R  R  K
 721 TCCAAGATCTGTAAACCTGTCCTGAAAGAAGGTCAAGTGTGTACCAAGCATAGGAGAAAA
 227 G  S  H  G  L  E  I  F  Q  R  C  Y  C  G  E  G  L  S  C  R
 781 GGCTCTCATGGACTAGAAATATTCCAGCGTTGTTACTGTGGAGAAGGTCTGTCTTGCCGG
 247 I  Q  K  D  H  H  Q  A  S  N  S  S  R  L  H  T  C  Q  R  H
 841 ATACAGAAAGATCACCATCAAGCCAGTAATTCTTCTAGGCTTCACACTTGTCAGAGACAC
 267 *
 901 TAAaccagctatccaaatgcagtgaactccttttatataatagatgctatgaaaaccttt
 961 tatgaccttcatcaactcaatcctaaggatatacaagttctgtggtttcagttaagcatt
1021 ccaataacaccttccaaaaacctggagtgtaagagctttgtttctttatggaactcccct
1081 gtgattgcagtaaattactgtattgtaaattctcagtgtggcacttacctgtaaatgcaa
1141 tgaaacttttaattatttttctaaaggtgctgcactgcctatttttcctcttgttatgta
1201 aatttttgtacacattgattgttatcttgactgacaaatattctatattgaactgaagta
1261 aatcatttcagcttatagttcttaaaagcataacccttaccccatttaattctagagtc
1321 tagaacgcaaggatctcttggaatgacaaatgataggtacctaaaatgtaacatgaaaat
1381 actagcttattttctgaaatgtactatcttaatgcttaaattatatttccctttaggctg
1441 tgatagtttttgaaataaaatttaacatttaatatcatgaaatgttataagtagacataa
1501 aaaaaaaaaaaaaaaaaaa
```

Figure 2E The cDNA (SEQ ID NO:29) and amino acid sequence (SEQ ID NO:30) of 151P4E11. The start methionine is underlined. The open reading frame extends from nucleic acid 3-374 including the stop codon.

```
  1   M  A  R  G  S  A  L  L  L  A  S  L  L  L  A  A  A  L  S  A
  1 agATGGCCCGAGGCAGCGCCCTCCTGCTCGCCTCCCTCCTCCTCGCCGCGGCCCTTTCTG
 21   S  A  G  L  W  S  P  A  K  E  K  R  G  W  T  L  N  S  A  G
 61 CCTCTGCGGGGCTCTGGTCGCCGGCCAAGGAAAAACGAGGCTGGACCCTGAACAGCGCGG
 41   Y  L  L  G  P  H  A  V  G  N  H  R  S  F  S  D  K  N  G  L
121 GCTACCTGCTGGGCCCACATGCCGTTGGCAACCACAGGTCATTCAGCGACAAGAATGGCC
 61   T  S  K  R  E  L  R  P  E  D  D  M  K  P  G  S  F  D  R  S
181 TCACCAGCAAGCGGGAGCTGCGGCCCGAAGATGACATGAAACCAGGAAGCTTTGACAGGT
 81   I  P  E  N  N  I  M  R  T  I  I  E  F  L  S  F  L  H  L  K
241 CCATACCTGAAAACAATATCATGCGCACAATCATTGAGTTTCTGTCTTTCTTGCATCTCA
101   E  A  G  A  L  D  R  L  L  D  L  P  A  A  A  S  S  E  D  I
301 AAGAGGCCGGTGCCCTCGACCGCCTCCTGGATCTCCCCGCCGCAGCCTCCTCAGAAGACA
121   E  R  S  *
361 TCGAGCGGTCCTGAgagcctcctgggcacgtttgtctgtgtgctgtaacctgaagtcaaa
421 ccttaagataatggataatcttcggccaatttatgcggagtcagccattcctgttctctt
481 tgccttgatgttgtgttgttatcatttaagatttttttttttggtaattattttgagtg
541 gcaaaataaagaatagcaatta
```

Figure 2F The cDNA (SEQ ID NO:31) and amino acid sequence (SEQ ID NO:32) of 154P2A8. The start methionine is underlined. The open reading frame extends from nucleic acid 250-1326 including the stop codon.

```
   1 ggcacgagggtttcgttttcatgctttaccagaaaatccacttccctgccgaccttagtt
  61 tcaaagcttattcttaattagagacaagaaacctgtttcaacttgaagacaccgtatgag
 121 gtgaatggacagccagccaccacaatgaaagaaatcaaaccaggaataacctatgctgaa
 181 cccacgcctcaatcgtccccaagtgtttcctgacacgcatctttgcttacagtgcatcac
   1           M  G  F  N  L  T  L  A  K  L  P  N  N  E  L  H  G
 241 aactgaagaATGGGGTTCAACTTGACGCTTGCAAAATTACCAAATAACGAGCTGCACGGC
  18 Q  E  S  H  N  S  G  N  R  S  D  G  P  G  K  N  T  T  L  H
 301 CAAGAGAGTCACAATTCAGGCAACAGGAGCGACGGGCCAGGAAAGAACACCACCCTTCAC
  38 N  E  F  D  T  I  V  L  P  V  L  Y  L  I  I  F  V  A  S  I
 361 AATGAATTTGACACAATTGTCTTGCCGGTGCTTTATCTCATTATATTTGTGGCAAGCATC
  58 L  L  N  G  L  A  V  W  I  F  F  H  I  R  N  K  T  S  F  I
 421 TTGCTGAATGGTTTAGCAGTGTGGATCTTCTTCCACATTAGGAATAAAACCAGCTTCATA
  78 F  Y  L  K  N  I  V  V  A  D  L  I  M  T  L  T  F  P  F  R
 481 TTCTATCTCAAAAACATAGTGGTTGCAGACCTCATAATGACGCTGACATTTCCATTTCGA
  98 I  V  H  D  A  G  F  G  P  W  Y  F  K  F  I  L  C  R  Y  T
 541 ATAGTCCATGATGCAGGATTTGGACCTTGGTACTTCAAGTTTATTCTCTGCAGATACACT
 118 S  V  L  F  Y  A  N  M  Y  T  S  I  V  F  L  G  L  I  S  I
 601 TCAGTTTTGTTTTATGCAAACATGTATACTTCCATCGTGTTCCTTGGGCTGATAAGCATT
 138 D  R  Y  L  K  V  V  K  P  F  G  D  S  R  M  Y  S  I  T  F
 661 GATCGCTATCTGAAGGTGGTCAAGCCATTTGGGGACTCTCGGATGTACAGCATAACCTTC
 158 T  K  V  L  S  V  C  V  W  V  I  M  A  V  L  S  L  P  N  I
 721 ACGAAGGTTTTATCTGTTTGTGTTTGGGTGATCATGGCTGTTTTGTCTTTGCCAAACATC
 178 I  L  T  N  G  Q  P  T  E  D  N  I  H  D  C  S  K  L  K  S
 781 ATCCTGACAAATGGTCAGCCAACAGAGGACAATATCCATGACTGCTCAAAACTTAAAAGT
 198 P  L  G  V  K  W  H  T  A  V  T  Y  V  N  S  C  L  F  V  A
 841 CCTTTGGGGGTCAAATGGCATACGGCAGTCACCTATGTGAACAGCTGCTTGTTTGTGGCC
 218 V  L  V  I  L  I  G  C  Y  I  A  I  S  R  Y  I  H  K  S  S
 901 GTGCTGGTGATTCTGATCGGATGTTACATAGCCATATCCAGGTACATCCACAAATCCAGC
 238 R  Q  F  I  S  Q  S  S  R  K  R  K  H  N  Q  S  I  R  V  V
 961 AGGCAATTCATAAGTCAGTCAAGCCGAAAGCGAAAACATAACCAGAGCATCAGGGTTGTT
 258 V  A  V  F  F  T  C  F  L  P  Y  H  L  C  R  I  P  F  T  F
1021 GTGGCTGTGTTTTTTACCTGCTTTCTACCATATCACTTGTGCAGAATTCCTTTTACTTTT
 278 S  H  L  D  R  L  L  D  E  S  A  Q  K  I  L  Y  Y  C  K  E
1081 AGTCACTTAGACAGGCTTTTAGATGAATCTGCACAAAAAATCCTATATTACTGCAAAGAA
 298 I  T  L  F  L  S  A  C  N  V  C  L  D  P  I  I  Y  F  F  M
1141 ATTACACTTTTCTTGTCTGCGTGTAATGTTTGCCTGGATCCAATAATTTACTTTTTCATG
 318 C  R  S  F  S  R  R  L  F  K  K  S  N  I  R  T  R  S  E  S
1201 TGTAGGTCATTTTCAAGAAGGCTGTTCAAAAAATCAAATATCAGAACCAGGAGTGAAAGC
 338 I  R  S  L  Q  S  V  R  R  S  E  V  R  I  Y  Y  D  Y  T  D
1261 ATCAGATCACTGCAAAGTGTGAGAAGATCGGAAGTTCGCATATATTATGATTACACTGAT
 358 V  *
1321 GTGTAGgcctttattgtttgttggaatcgatatgtacaaagtgtaaataaatgtttcttt
1381 ttcattatccttaaaaaaaaaa
```

Figure 2G The cDNA (SEQ ID NO:33) and amino acid sequence (SEQ ID NO:34) of 156P1D4. The start methionine is underlined. The open reading frame extends from nucleic acid 24-692 including the stop codon.

```
   1                        M  L  W  L  L  F  F  L  V  T  A  I  H
   1 cttgtgttttccaccctgaaagaATGTTGTGGCTGCTCTTTTTTCTGGTGACTGCCATTC
  14   A  E  L  C  Q  P  G  A  E  N  A  F  K  V  R  L  S  I  R  T
  61 ATGCTGAACTCTGTCAACCAGGTGCAGAAAATGCTTTTAAAGTGAGACTTAGTATCAGAA
  34   A  L  G  D  K  A  Y  A  W  D  T  N  E  E  Y  L  F  K  A  M
 121 CAGCTCTGGGAGATAAAGCATATGCCTGGGATACCAATGAAGAATACCTCTTCAAAGCGA
  54   V  A  F  S  M  R  K  V  P  N  R  E  A  T  E  I  S  H  V  L
 181 TGGTAGCTTTCTCCATGAGAAAAGTTCCCAACAGAGAAGCAACAGAAATTTCCCATGTCC
  74   L  C  N  V  T  Q  R  V  S  F  W  F  V  V  T  D  P  S  K  N
 241 TACTTTGCAATGTAACCCAGAGGGTATCATTCTGGTTTGTGGTTACAGACCCTTCAAAAA
  94   H  T  L  P  A  V  E  V  Q  S  A  I  R  M  N  K  N  R  I  N
 301 ATCACACCCTTCCTGCTGTTGAAGTGCAATCAGCCATAAGAATGAACAAGAACCGGATCA
 114   N  A  F  F  L  N  D  Q  T  L  E  F  L  K  I  P  S  T  L  A
 361 ACAATGCCTTCTTTCTAAATGACCAAACTCTGGAATTTTTAAAAATCCCTTCCACACTTG
 134   P  P  M  D  P  S  V  P  I  W  I  I  I  F  G  V  I  F  C  I
 421 CACCACCCATGGACCCATCTGTGCCCATCTGGATTATTATATTTGGTGTGATATTTTGCA
 154   I  I  V  A  I  A  L  L  I  L  S  G  I  W  Q  R  R  R  K  N
 481 TCATCATAGTTGCAATTGCACTACTGATTTTATCAGGGATCTGGCAACGTAGAAGAAAGA
 174   K  E  P  S  E  V  D  D  A  E  D  K  C  E  N  M  I  T  I  E
 541 ACAAAGAACCATCTGAAGTGGATGACGCTGAAGATAAGTGTGAAAACATGATCACAATTG
 194   N  G  I  P  S  D  P  L  D  M  K  G  G  H  I  N  D  A  F  M
 601 AAAATGGCATCCCCTCTGATCCCCTGGACATGAAGGGAGGGCATATTAATGATGCCTTCA
 214   T  E  D  E  R  L  T  P  L  *
 661 TGACAGAGGATGAGAGGCTCACCCCTCTCTGAagggctgttgttctgcttcctcaagaaa
 721 ttaaacatttgtttctgtgtgactgctgagcatcctgaaataccaagagcagatcatata
 781 ttttgtttcaccattcttcttttgtaataaattttgaatgtgcttgaaagtgaaaagcaa
 841 tcaattatacccaccaacaccactgaaatcataagctattcacgactcaaaatattctaa
 901 aatatttttctgacagtatagtgtataaatgtggtcatgtggtatttgtagttattgatt
 961 taagcattttagaaataagatcaggcatatgtatatattttcacacttcaaagacctaa
1021 ggaaaaataaatttccagtggagaatacatataatatggtgtagaaatcattgaaaatg
1081 gatccttttgacgatcacttatatcactctgtatatgactaagtaaacaaaagtgagaa
1141 gtaattattgtaaatggatggataaaaatggaattactcatatacagggtggaattttat
1201 cctgttatcacaccaacagttgattatatattttctgaatatcagcccctaataggacaa
1261 ttctatttgttgaccatttctacaatttgtaaaagtccaatctgtgctaacttaataaag
1321 taataatcatctctttttgattgtg
```

Figure 2H The cDNA (SEQ ID NO:35) and amino acid sequence (SEQ ID NO:36) of 156P5C12. The start methionine is underlined. The open reading frame extends from nucleic acid 178-861 including the stop codon.

```
  1 ttcggcacgagcggcacgagaagccccagacggtatctccgagatgccagtgagcggctg
 61 agagctgaagcccccctggacactcaaggctcttgtggtgacagtctgacgtaaaggcgtg
  1                                                            M
121 cagggaggcctagctctgtctcctggacttagagatttcagacacagaagtctgtccATG
  2 A  P  C  H  I  R  K  Y  Q  E  S  D  R  Q  W  V  V  G  L  L
181 GCTCCTTGTCACATCCGCAAATACCAGGAGAGCGACCGCCAGTGGGTTGTGGGCTTGCTC
 22 S  R  G  M  A  E  H  A  P  A  T  F  R  Q  L  L  K  L  P  R
241 TCCCGGGGGATGGCCGAGCATGCCCCAGCCACCTTCCGGCAATTGCTGAAGCTGCCTCGA
 42 T  L  I  L  L  L  G  G  P  L  A  L  L  L  V  S  G  S  W  L
301 ACCCTCATACTCTTACTTGGGGGGCCCCTCGCCCTACTCCTGGTCTCTGGATCCTGGCTT
 62 L  A  L  V  F  S  I  S  L  F  P  A  L  W  F  L  A  K  K  P
361 CTAGCCCTCGTGTTCAGCATCAGCCTCTTCCCTGCCCTGTGGTTCCTTGCCAAAAAACCC
 82 W  T  E  Y  V  D  M  T  L  C  T  D  M  S  D  I  T  K  S  Y
421 TGGACGGAGTATGTGGACATGACATTGTGCACAGACATGTCTGACATTACCAAATCCTAC
102 L  S  E  R  G  S  C  F  W  V  A  E  S  E  E  K  V  V  G  M
481 CTGAGTGAGCGTGGCTCCTGCTTCTGGGTGGCTGAGTCTGAAGAGAAGGTGGTGGGCATG
122 V  G  A  L  P  V  D  D  P  T  L  R  E  K  R  L  Q  L  F  H
541 GTAGGAGCTCTGCCTGTTGATGATCCCACCTTGAGGGAGAAGCGGTTGCAGCTGTTTCAT
142 L  S  V  D  S  E  H  R  R  Q  G  I  A  K  A  L  V  R  T  V
601 CTCTCTGTGGACAGTGAGCACCGTCGTCAGGGGATAGCAAAAGCCCTGGTCAGGACTGTC
162 L  Q  F  A  R  D  Q  G  Y  S  E  V  I  L  D  T  G  T  I  Q
661 CTCCAGTTTGCCCGGGACCAGGGCTACAGTGAAGTTATCCTGGACACCGGCACCATCCAG
182 L  S  A  M  A  L  Y  Q  S  M  G  F  K  K  T  G  Q  S  F  F
721 CTCTCTGCTATGGCCCTCTACCAGAGCATGGGCTTCAAGAAGACGGGCCAGTCCTTCTTC
202 C  V  W  A  R  L  V  A  L  H  T  V  H  F  I  Y  H  L  P  S
781 TGTGTGTGGGCCAGGCTAGTGGCTCTTCATACAGTTCATTTCATCTACCACCTCCCTTCT
222 S  K  V  G  S  L  *
841 TCTAAGGTAGGGAGTCTGTGAtctctttctgtgtgtattggtcagaatagaatccattca
901 gctgtagcagcaagcaatccccaacctttcactgcaatgacctttcaatgcaataaaagc
961 ttattgtccattcaaaaaaaaaaaaaaaaaaa
```

Figure 2I The cDNA (SEQ ID NO:37) and amino acid sequence (SEQ ID NO:38) of 159P2B5. The start methionine is underlined. The open reading frame extends from nucleic acid 1517-2191 including the stop codon.

```
   1 atcagtgggccagagctcgccgggtggccgcaagtacgccggcccagcccgcagcgcgcc
  61 cagccggaaggcggggaatccggctgacaccgcgccccgggttcccaggccacctcctct
 121 gttctgaggctgggctgggagaccgtggggctgtgaggagcgcatagaaccgtggtggag
 181 ggcgaggctgggccaccggctcttcaagctcggaatggaggggaagagcgcagagggct
 241 ggctgggaggaactcgggtgggcgtgaaggagacgagggcaagaaaagaaacttcccttc
 301 ttccaggagggtcttcgaaaccctctccccacagcccctctcgtcattagcatggcaatg
 361 aggagtttctgtaattcgacttggaggggcggatgagccctggaaactcagagctcgccg
 421 gaaaaggccgggggcggccgggctcttcttccccaccttccctctctcgtcgctctccgc
 481 ccctttctctttcccactcagttttgcaccgggagccctccgggatgcggagctactcga
 541 ccgccggattttaggggtaggaggcgggggagagagatgacgctggcggacgtggccag
 601 cgcgggggccgggcggtgcgctgcaggccatctgccggcgccctgagacccaggagcctc
 661 cgcgctcccgcgtgggcctcacagggccggtccacagctccaacatagtagctgaactcc
 721 cttcgttgcgttcctctttttctggaggggaatgttagaagagagagagagcttcctttt
 781 ataaccttcctcattctgctgcacgtctagagtgggtgtgggggctggcaggtgggaggg
 841 gcggtggacaaatggctgatggtggacgggacactttaccccaacgacacctcctcccct
 901 ttccaactggctgtgtagttgcttatgagaaccttcaagtccttccctagagagacacat
 961 gcaaatctgagcctcatcccaggccaggggtcctgttcctcatcaccctacttccctgag
1021 gctgctgaggtcgttaaattgttgtttactattaggtttcacgtcaaccctgggcttgta
1081 gagagaaaaagccaaacggagaccaagaattgatgcagtcttgggtaggagaaatcgaga
1141 gcttgtccaggaagctttgctgtataaattataagcaatgctgtataaatttttactccaa
1201 ccatgtgtacaatgttggaatcagatgaaatttatagtgaatgaatgtatgtgggtttgg
1261 ggtttccactcctcttcagcctttcctcccgttagaacaaggaaggtttttttttttca
1321 aggaaggtacatttcaaatatgttagtcaccctttcagtcttctgtattctgttctccac
1381 gtaccgaagttcccccaaacctgtcctctcaagagaaaaaacccatgctgactctggact
1441 ccctcagtaacaatgaaacattctccccaaacatttcctttcagaatagtatttgtgact
   1                  M  V  K  R  E  H  G  Q  E  R  P  T  F  W  G
1501 ttgatccatcccaagcATGGTTAAGAGGGAGCACGGGCAGGAAAGGCCCACTTTCTGGGG
  16  W  A  A  T  P  A  P  V  S  A  P  G  N  P  P  T  G  E  G  E
1561 TTGGGCAGCCACCCCTGCCCCAGTTTCGGCTCCTGGGAATCCTCCGACTGGAGAAGGGGA
  36  R  Q  G  S  P  P  G  G  G  F  L  G  S  T  S  F  Q  R  R  G
1621 AAGGCAAGGCAGTCCTCCTGGAGGCGGCTTCCTTGGGAGCACCAGCTTCCAGCGGCGGGG
  56  E  K  E  L  L  W  E  R  G  Q  D  V  S  R  S  V  L  A  M  R
1681 AGAGAAGGAGCTCCTGTGGGAGAGGGGGCAGGATGTGAGTAGGTCGGTGCTGGCTATGCG
  76  A  I  L  P  P  S  L  S  K  S  V  H  F  P  P  L  P  H  S  C
1741 AGCAATCCTCCCTCCAAGCCTGAGCAAGTCGGTACATTTTCCCCCGCTGCCTCATTCCTG
  96  T  L  V  A  L  L  S  L  G  L  Q  D  P  L  G  C  R  A  P  A
1801 TACCTTGGTTGCCCTCCTCAGCCTGGGTTTGCAGGACCCCCTCGGCTGCAGGGCGCCTGC
 116  T  K  P  T  P  A  G  A  T  L  S  A  S  S  L  P  R  P  C  S
1861 CACAAAGCCGACCCCGGCAGGAGCCACTCTCTCTGCTAGTTCGCTGCCTCGGCCCTGCTC
 136  P  S  A  S  L  L  L  S  W  P  L  F  W  G  I  L  G  G  V  F
1921 TCCCTCAGCCTCTCTTCTTCTCTCCTGGCCTCTTTTCTGGGGCATCCTGGGTGGAGTGTT
 156  F  L  G  S  R  A  C  T  R  T  Q  A  R  R  H  T  G  P  A  A
1981 TTTCTTGGGATCACGAGCTTGCACTCGCACACAGGCCCGCAGACACACAGGCCCGGCGGC
 176  A  L  L  R  L  L  F  P  A  P  R  R  P  G  A  R  S  R  A  G
2041 CGCCCTTCTCCGCTTACTGTTCCCGGCTCCCCGCAGGCCGGGTGCTCGCAGCCGGGCTGG
 196  Y  A  S  P  G  S  P  E  R  R  S  P  G  T  A  H  K  G  S  L
2101 CTATGCCTCGCCTGGCAGCCCAGAGCGCCGCTCCCCGGGAACAGCACACAAAGGCAGCCT
 216  P  W  P  L  A  L  R  L  L  *
2161 CCCCTGGCCTCTAGCCCTTAGGCTTCTGTAGctcagttctttccccacacccctcccccca
2221 agaaattctgggggccgttccaccgagtaggagatccttggccctctaggcaagtaggtc
2281 agcgccccaagactggagctggtctctttcaacgccttgggagactgggtgaaaggcgag
2341 cttggttacgcttaaaatgatcgcctacaagcggttctcttggctcaaaacgcctctttc
2401 agggctcttatgctagaaaggaaaggaataaggaggagataaaatgacgccgaggccctg
2461 aactgttcatggcatccgcggctcagccaagctgttgttttaaaagagcaataaaaatga
2521 attatgact
```

Figure 2J The cDNA (SEQ ID NO:39) and amino acid sequence (SEQ ID NO:40) of 161P2B7A. The start methionine is underlined. The open reading frame extends from nucleic acid 198-770 including the stop codon.

```
   1 gccgcccaggattccacgagggggaaggattctctattctttttgcgacaaatctggta
  61 acaggatttgctgtgctgttttcgtccgtgtgtgtgtgcgtgtgtgtgtgtgttcgtgtg
 121 gatgcacgtgtggccccgctggggtgccccctccagtgtccccggagctgaaagatcgca
   1                  M  E  D  E  G  Q  T  K  I  K  Q  R  R  S  R
 181 aagaggatgcgaaagggATGGAGGACGAAGGCCAGACCAAAATCAAGCAGAGGCGAAGTC
  16   T  N  F  T  L  E  Q  L  N  E  L  E  R  L  F  D  E  T  H  Y
 241 GGACCAATTTCACCCTGGAACAACTCAATGAGCTGGAGAGGCTTTTTGACGAGACCCACT
  36   P  D  A  F  M  R  E  E  L  S  Q  R  L  G  L  S  E  A  R  V
```

Figure 2J (continued)

```
 301 ATCCCGACGCCTTCATGCGAGAGGAACTGAGCCAGCGACTGGGCCTGTCGGAGGCCCGAG
  56   Q  V  W  F  Q  N  R  R  A  K  C  R  K  Q  E  N  Q  L  H  K
 361 TGCAGGTTTGGTTTCAAAATCGAAGAGCTAAATGTAGAAAACAAGAAAATCAACTCCATA
  76   G  V  L  I  G  A  A  S  Q  F  E  A  C  R  V  A  P  Y  V  N
 421 AAGGTGTTCTCATAGGGGCCGCCAGCCAGTTTGAAGCTTGTAGAGTCGCACCTTATGTCA
  96   V  G  A  L  R  M  P  F  Q  Q  V  Q  A  Q  L  Q  L  D  S  A
 481 ACGTAGGTGCTTTAAGGATGCCATTTCAGCAGGTTCAGGCGCAGCTGCAGCTGGACAGCG
 116   V  A  H  A  H  H  H  L  H  P  H  L  A  A  H  A  P  Y  M  M
 541 CTGTGGCGCACGCGCACCACCACCTGCATCCGCACCTGGCCGCGCACGCGCCCTACATGA
 136   F  P  A  P  P  F  G  L  P  L  A  T  L  A  A  D  S  A  S  A
 601 TGTTCCCAGCACCGCCCTTCGGACTGCCGCTCGCCACGCTGGCCGCGGATTCGGCTTCCG
 156   A  S  V  V  A  A  A  A  A  A  K  T  T  S  K  N  S  S  I  A
 661 CCGCCTCGGTAGTGGCGGCCGCAGCAGCCGCCAAGACCACCAGCAAGAACTCCAGCATCG
 176   D  L  R  L  K  A  K  K  H  A  A  A  L  G  L  *
 721 CCGATCTCAGACTGAAAGCCAAAAAGCACGCCGCAGCCCTGGGTCTGTGAcgccaacgcc
 781 agcaccaatgtcgcgcctgtcccgcggcactcagcctgcacgccctccgcgccccgctgc
 841 ttctccgttacccctttgagacctcgggagccggccctcttcccgcctcactgaccatcc
 901 ctcgtcccctatcgcatcttggactcggaaagccagactccacgcaggaccagggatctc
 961 acgaggcacgcaggctccgtggctcctgcccgttttcctactcgagggcctagaattggg
1021 ttttgtaggagcgggtttgggggagtctggagagagactggacaggggagtgctggaacc
1081 gcggagtttggctcaccgcaaagctacaacgatggactcttgcatagaaaaaaaaatctt
1141 gttaacaatgaaaaaatgagcaaacaaaaaaatcgaaagacaaacgggagagaaaaagag
1201 gaaggaaacttatttcttaactgctatttggcagaagctgaaattggagaaccaaggagc
1261 aaaaacaaattttaaattaaagtattttatacatttaaaaatatggaaaaacaacccag
1321 acgattctcgagagactgggggagttaccaacttaaatgtgtgtttttaaaaatgcgct
1381 aagaaggcaaagcagaaagaagaggtatacttatttaaaaaactaagatgaaaaagtgc
1441 gcagctgggaagttcacaggttttgaaactgaccttttctgcgaagttcacgttaatac
1501 gagaaatttgatgagagaggcggctctttacgttgaatcagatgctttgagtttaaaac
1561 ccaccatgtatggaagagcaagaaaagagaaatattaaaacgaggagagagaaaaataa
1621 tattaacacaaaaaaatgccacagacaatgatttctctgagaaattattatggcaaaact
1681 gtctggactgctgacagtaaattccggtttgcatgttacttgtattccattgatggtgtg
1741 tcttcctcccacccccttatctcccatgcactcactccattttcatcttcactatgaaaa
1801 acaataccaaaagtatctggaaattgatatatatatatccacatatatatatcatatatt
1861 tgccatatatatatatatatatatatatatatatatatatatatatatatatatttgccc
1921 tgtctttgatcctggggaacaaaagaaaaaagtcagaaagggaaaaaattacactcattg
1981 ccctaagaagacagaggtgggcagaatatgtggggaaaggaaaaagaaaacaagaccacc
2041 aaatgaaataatgaaggtacagcgcctcgctgtgccagacacagtaggcgctcaatcagt
2101 attagttcccaccattccccttttcttgtgttccttcttgttggtttcctgaagtcctat
2161 ttgaagacagtggtttatttccccctctctatcccgtcaaattcaccttaaataacaccc
2221 agctagatacaggcactaggtttgtgtaagatatgttgatacacacgaacaaagtttatt
2281 ttgactataatgtgtggactgactttcaacatttgcattttatctcacaaaggtgtatct
2341 attcaagtaacctttttttttttgtttgtttgtttctttttttgttttttttttttcttttg
2401 gttgtttgtttcaattcatgtagctatttaaactgggataccttggactaagccagtctg
2461 tatcccaattcgctagcaagcctaagtttgtggggttttgtttttgtttttgttttacct
2521 tctaatttacaagaaagaggaaaagctcttctaactgaactttggtatgcggttgagctt
2581 tgtaactatttgttctccatgaaaacaaaattatttatatttgacatatttttttctagt
2641 gtattaagttattttaaacaaaagatgttatctcatgacgtgttgtcagtacaaaatgtg
2701 tcgcctccaattctgttaaacctttttaaataagtgccaagttattaatt
```

Figure 2K The cDNA (SEQ ID NO:41) and amino acid sequence (SEQ ID NO:42) of 179P3G7. The start methionine is underlined. The open reading frame extends from nucleic acid 72-1100 including the stop codon.

```
   1 cggatggggaaaaaaaaagatgtcagctcctccgctgtagtattgctccttaaaaacccc
   1              M  T  C  P  R  N  V  T  P  N  S  Y  A  E  P  L  A
  61 tctctctgaaaATGACATGCCCTCGCAATGTAACTCCGAACTCGTACGCGGAGCCCTTGG
  18   A  P  G  G  G  E  R  Y  S  R  S  A  G  M  Y  M  Q  S  G  S
 121 CTGCGCCCGGCGGAGGAGAGCGCTATAGCCGGAGCGCAGGCATGTATATGCAGTCTGGGA
  38   D  F  N  C  G  V  M  R  G  C  G  L  A  P  S  L  S  K  R  D
 181 GTGACTTCAATTGCGGGGTGATGAGGGGCTGCGGGCTCGCCCCCTCGCTCTCCAAGAGGG
  58   E  G  S  S  P  S  L  A  L  N  T  Y  P  S  Y  L  S  Q  L  D
 241 ACGAGGGCAGCAGCCCCAGCCTCGCCCTCAACACCTATCCGTCCTACCTCTCGCAGCTGG
  78   S  W  G  D  P  K  A  A  Y  R  L  E  Q  P  V  G  R  P  L  S
 301 ACTCCTGGGGCGACCCCAAAGCCGCCTATCGCCTGGAACAACCTGTTGGCAGGCCGCTGT
  98   S  C  S  Y  P  P  S  V  K  E  E  N  V  C  C  M  Y  S  A  E
 361 CCTCCTGCTCCTACCCACCTAGTGTCAAGGAGGAGAATGTCTGCTGCATGTACAGCGCAG
 118   N  R  A  K  S  G  P  E  A  A  L  Y  S  H  P  L  P  E  S  C
 421 AGAACCGGGCGAAAAGTGGCCCTGAGGCAGCTCTCTACTCCCACCCCTTGCCGGAGTCCT
 138   L  G  E  H  E  V  P  V  P  S  Y  Y  R  A  S  P  S  Y  S  A
 481 GCCTTGGGGAGCACGAGGTACCCGTCCCCAGCTACTACCGCGCCAGCCCGAGCTACTCCG
```

Figure 2K (continued)

```
 158  L  D  K  T  P  H  C  S  G  A  N  D  F  E  A  P  F  E  Q  R
 541 CGCTGGACAAGACGCCCCACTGTTCTGGGGCCAACGACTTCGAAGCCCCTTTCGAGCAGC
 178  A  S  L  N  P  R  A  E  H  L  E  S  P  Q  L  G  G  K  V  S
 601 GGGCCAGTCTCAACCCGCGCGCCGAACATCTGGAATCGCCTCAGCTGGGGGGCAAAGTGA
 198  F  P  E  T  P  K  S  D  S  Q  T  P  S  P  N  E  I  K  T  E
 661 GTTTCCCTGAGACCCCCAAGTCCGACAGCCAGACCCCCAGCCCCAATGAAATCAAGACGG
 218  Q  S  L  A  G  P  K  G  S  P  S  E  S  E  K  E  R  A  K  A
 721 AGCAGAGCCTGGCGGGCCCTAAAGGGAGCCCCTCGGAGAGCGAAAAGGAGAGGGCCAAAG
 238  A  D  S  S  P  D  T  S  D  N  E  A  K  E  E  I  K  A  E  N
 781 CTGCCGACTCCAGCCCAGACACCTCGGATAACGAAGCGAAAGAGGAGATAAAGGCAGAAA
 258  T  T  G  N  W  L  T  A  K  S  G  R  K  K  R  C  P  Y  T  K
 841 ACACCACAGGAAATTGGCTGACTGCAAAGAGCGGAAGGAAGAAGAGGTGCCCCTATACTA
 278  H  Q  T  L  E  L  E  K  E  F  L  F  N  M  Y  L  T  R  E  R
 901 AACACCAGACGCTGGAATTGGAGAAAGAATTTCTGTTCAATATGTATTTGACGCGAGAGC
 298  R  L  E  I  S  K  T  I  N  L  T  D  R  Q  V  K  I  W  F  Q
 961 GCCGCCTGGAGATTAGCAAGACCATTAACCTTACAGACAGACAAGTCAAAATCTGGTTTC
 318  N  R  R  M  K  L  K  K  M  N  R  E  N  R  I  R  E  L  T  S
1021 AAAATCGCAGAATGAAACTCAAGAAAATGAACCGAGAGAATCGGATCCGGGAACTGACCT
 338  N  F  N  F  T  *
1081 CCAATTTTAATTTCACCTGAgagcgcggcctctcctcctcccttcccgctccttgctctc
1141 cccgcccctcctccctttgtgcctggtgatatatttttttttcctccctgagtataaatg
1201 caatgcgactgcaaaaaaggcaaagacctcagactctccttccaagggacctgtggttcg
1261 tgctgcgaagatgcttccacttaaagcatgagaaatggggtgccgggatgtggggtgtgg
1321 tgtgtgccctcatagatgggggtgggagtgtggctggtgtgtgtgtcaaaccctcactca
1381 cccacgcactcacacacagcattctgttctccatgcaaagttaagatcgaatccatccgc
1441 ttgtaggggaaaaaaaggaaaaaaattaaccagagagggtctgtaatctcgcagagcaca
1501 ggcagaatcgttccttccttgctgcatttcctccttagactaatagacgttttggaaagt
1561 tcggctagtgttcgtgtgtttgtcgtagcacccagagcctccaccaaaccctctccatgt
1621 ctttacctcccagtcgctctaagatctgcttgaagtctcgtatttgtactgctttctgct
1681 tttctcccacccctcctagcacccccacatcccccatctagtaacatctcagaaatttca
1741 tccagaggaacaaaaaaattaaaaatagaacatagcaaagcaaagacagaatgcccccc
1801 ccaaatattgtcctgtccctgtctgggagttgtgttatttaaagatattctgtatgttgt
1861 atcttttgcatgtagcttccttaatggagaaaaaaaaatcctaataaatttccagaatca
1921 taaaaaaaaaaaaaaaaaaa
```

Figure 2L The cDNA (SEQ ID NO:43) and amino acid sequence (SEQ ID NO:44) of 184P3C10B. The start methionine is underlined. The open reading frame extends from nucleic acid 118-1236 including the stop codon.

```
   1 actctttcttcggctcgcgagctgagaggagcaggtagaggggcagaggcgggactgtcg
   1                                                          M
  61 tctgggggagccgcccaggaggctcctcaggccgaccccagaccctggctggccaggATG
   2 K  Y  L  R  H  R  R  P  N  A  T  L  I  L  A  I  G  A  F  T
 121 AAGTATCTCCGGCACCGGCGGCCCAATGCCACCCTCATTCTGGCCATCGGCGCTTTCACC
  22 L  L  L  F  S  L  L  V  S  P  P  T  C  K  V  Q  E  Q  P  P
 181 CTCCTCCTCTTCAGTCTGCTAGTGTCACCACCCACCTGCAAGGTCCAGGAGCAGCCACCG
  42 A  I  P  E  A  L  A  W  P  T  P  P  T  R  P  A  P  A  P  C
 241 GCGATCCCCGAGGCCCTGGCCTGGCCCACTCCACCCACCCGCCCAGCCCCGGCCCCGTGC
  62 H  A  N  T  S  M  V  T  H  P  D  F  A  T  Q  P  Q  H  V  Q
 301 CATGCCAACACCTCTATGGTCACCCACCCGGACTTCGCCACGCAGCCGCAGCACGTTCAG
  82 N  F  L  L  Y  R  H  C  R  H  F  P  L  L  Q  D  V  P  P  S
 361 AACTTCCTCCTGTACAGACACTGCCGCCACTTTCCCCTGCTGCAGGACGTGCCCCCCTCT
 102 K  C  A  Q  P  V  F  L  L  L  V  I  K  S  S  P  S  N  Y  V
 421 AAGTGCGCGCAGCCGGTCTTCCTGCTGCTGGTGATCAAGTCCTCCCCTAGCAACTATGTG
 122 R  R  E  L  L  R  R  T  W  G  R  E  R  K  V  R  G  L  Q  L
 481 CGCCGCGAGCTGCTGCGGCGCACGTGGGGCCGCGAGCGCAAGGTACGGGGTTTGCAGCTG
 142 R  L  L  F  L  V  G  T  A  S  N  P  H  E  A  R  K  V  N  R
 541 CGCCTCCTCTTCCTGGTGGGCACAGCCTCCAACCCGCACGAGGCCCGCAAGGTCAACCGG
 162 L  L  E  L  E  A  Q  T  H  G  D  I  L  Q  W  D  F  H  D  S
 601 CTGCTGGAGCTGGAGGCACAGACTCACGGAGACATCCTGCAGTGGGACTTCCACGACTCC
 182 F  F  N  L  T  L  K  Q  V  L  F  L  Q  W  Q  E  T  R  C  A
 661 TTCTTCAACCTCACGCTCAAGCAGGTCCTGTTCTTACAGTGGCAGGAGACAAGGTGCGCC
 202 N  A  S  F  V  L  N  G  D  D  D  V  F  A  H  T  D  N  M  V
 721 AACGCCAGCTTCGTGCTCAACGGGGATGATGACGTCTTTGCACACACAGACAACATGGTC
 222 F  Y  L  Q  D  H  D  P  G  R  H  L  F  V  G  Q  L  I  Q  N
 781 TTCTACCTGCAGGACCATGACCCTGGCCGCCACCTCTTCGTGGGGCAACTGATCCAAAAC
 242 V  G  P  I  R  A  F  W  S  K  Y  Y  V  P  E  V  V  T  Q  N
 841 GTGGGCCCCATCCGGGCTTTTTGGAGCAAGTACTATGTGCCAGAGGTGGTGACTCAGAAT
 262 E  R  Y  P  P  Y  C  G  G  G  G  F  L  L  S  R  F  T  A  A
 901 GAGCGGTACCCACCCTATTGTGGGGGTGGTGGCTTCTTGCTGTCCCGCTTCACGGCCGCT
```

Figure 2L (continued)

```
 282 A  L  R  R  A  A  H  V  L  D  I  F  P  I  D  D  V  F  L  G
 961 GCCCTGCGCCGTGCTGCCCATGTCTTGGACATCTTCCCCATTGATGATGTCTTCCTGGGT
 302 M  C  L  E  L  E  G  L  K  P  A  S  H  S  G  I  R  T  S  G
1021 ATGTGTCTGGAGCTTGAGGGACTGAAGCCTGCCTCCCACAGCGGCATCCGCACGTCTGGC
 322 V  R  A  P  S  Q  H  L  S  S  F  D  P  C  F  Y  R  D  L  L
1081 GTGCGGGCTCCATCGCAACACCTGTCCTCCTTTGACCCCTGCTTCTACCGAGACCTGCTG
 342 L  V  H  R  F  L  P  Y  E  M  L  L  M  W  D  A  L  N  Q  P
1141 CTGGTGCACCGCTTCCTACCTTATGAGATGCTGCTCATGTGGGATGCGCTGAACCAGCCC
 362 N  L  T  C  G  N  Q  T  Q  I  Y  *
1201 AACCTCACCTGCGGCAATCAGACACAGATCTACTGAgtcagcatcagggtccccagcctc
1261 tgggctcctgtttccataggaaggggcgacaccttcctcccaggaagctgagacctttgt
1321 ggtctgagcataagggagtgccagggaaggtttgaggtttgatgagtgaatattctggct
1381 ggcgaactcctacacatccttcaaaacccacctggtactgttccagcatcttccctggat
1441 ggctggaggaactccagaaaatatccatcttcttttgtggctgctaatggcagaagtgc
1501 ctgtgctagagttccaactgtggatgcatccgtcccgtttgagtcaaagtcttacttccc
1561 tgctctcacctactcacagacgggatgctaagcagtgcacctgcagtggtttaatggcag
1621 ataagctccgtctgcagttccaggccagccagaaactcctgtgtccacatagagctgacg
1681 tgagaaatatctttcagcccaggagagaggggtcctgatcttaaccctttcctgggtctc
1741 agacaactcagaaggttgggggataccagagaggtggtggaataggaccgcccctcct
1801 tacttgtgggatcaaatgctgtaatggtggaggtgtgggcagaggagggaggcaagtgtc
1861 ctttgaaagttgtgagagctcagagtttctggggtcctcattaggagcccccatccctgt
1921 gttccccaagaattcagagaacagcactggggctggaatgatctttaatgggcccaaggc
1981 caacaggcatatgcctcactactgcctggagaagggagagattcaggtcctccagcagcc
2041 tccctcacccagtatgttttacagattacgggggggaccgggtgagccagtgacccctgc
2101 agcccccagcttcaggcctcagtgtctgccagtcaagcttcacaggcattgtgatggggc
2161 agccttggggaatataaattttgtg
```

Figure 2M The cDNA (SEQ ID NO:45) and amino acid sequence (SEQ ID NO:46) of 184P3G10. The start methionine is underlined. The open reading frame extends from nucleic acid 14-2260 including the stop codon.

```
   1              M  N  T  A  F  A  G  K  M  V  S  V  T  K  Y  D
   1 ctgatggcgatgaATGAACACTGCGTTTGCTGGGAAGATGGTGTCGGTCACCAAATATGA
  17  L  T  G  C  S  A  F  C  R  S  C  Q  R  A  T  M  T  S  Q  P
  61 CCTTACTGGCTGCTCTGCCTTCTGCAGGTCCTGCCAGAGAGCCACCATGACCTCTCAGCC
  37  L  R  L  A  E  E  Y  G  P  S  P  G  E  S  E  L  A  V  N  P
 121 TCTCAGGCTAGCAGAAGAGTATGGCCCAAGTCCTGGGGAGTCTGAACTGGCTGTGAACCC
  57  F  D  G  L  P  F  S  S  R  Y  Y  E  L  L  K  Q  R  Q  A  L
 181 CTTTGATGGGCTTCCCTTCTCTTCCCGCTACTATGAGCTGCTGAAGCAGCGCCAAGCCTT
  77  P  I  W  A  A  R  F  T  F  L  E  Q  L  E  S  N  P  T  G  V
 241 GCCCATCTGGGCTGCTCGCTTTACCTTCTTGGAGCAGTTGGAGAGTAACCCCACTGGAGT
  97  V  L  V  S  G  E  P  G  S  G  K  S  T  Q  I  P  Q  W  C  A
 301 GGTGCTGGTGTCTGGGGAGCCTGGTTCTGGCAAGAGCACCCAGATCCCTCAGTGGTGTGC
 117  E  F  A  L  A  R  G  F  Q  K  G  Q  V  T  V  T  Q  P  Y  P
 361 AGAGTTTGCGCTGGCCAGAGGGTTCCAGAAAGGACAGGTTACTGTTACTCAGCCCTACCC
 137  L  A  A  R  S  L  A  L  R  V  A  D  E  M  D  L  T  L  G  H
 421 TCTTGCAGCCCGGAGCCTGGCTCTGCGGGTTGCTGATGAGATGGACCTGACCCTGGGTCA
 157  E  V  G  Y  S  I  P  Q  E  D  C  T  G  P  N  T  L  L  R  F
 481 TGAGGTTGGATACAGCATCCCCCAGGAGGACTGCACGGGGCCCAACACCCTGCTCAGGTT
 177  C  W  D  R  L  L  L  Q  E  V  A  S  T  R  G  T  G  A  W  G
 541 CTGCTGGGACAGGCTGCTTCTGCAGGAGGTGGCCTCGACCCGAGGCACTGGAGCCTGGGG
 197  V  L  V  L  D  E  A  Q  E  R  S  V  A  S  D  S  L  Q  G  L
 601 CGTGCTGGTACTAGATGAGGCTCAGGAGCGGTCGGTGGCATCAGATTCACTCCAGGGGCT
 217  L  Q  D  A  R  L  E  K  L  P  G  D  L  R  V  V  V  V  T  D
 661 ACTGCAAGATGCCAGGCTGGAAAAACTTCCGGGGGACCTCAGAGTGGTTGTGGTTACTGA
 237  P  A  L  E  P  K  L  R  A  F  W  G  N  P  P  I  V  H  I  P
 721 CCCAGCCCTTGAACCTAAGCTCCGAGCTTTCTGGGGCAATCCTCCTATTGTGCATATACC
 257  R  E  P  G  E  R  P  S  P  I  Y  W  D  T  I  P  P  D  R  V
 781 CAGAGAGCCTGGTGAGAGACCTTCCCCCATCTACTGGGACACCATCCCACCTGATCGGGT
 277  E  A  A  C  Q  A  V  L  E  L  C  R  K  E  L  P  G  D  V  L
 841 GGAAGCTGCCTGCCAAGCAGTGCTTGAATTGTGTCGGAAGGAGCTTCCAGGAGATGTGCT
 297  V  F  L  P  S  E  E  E  I  S  L  C  C  E  S  L  S  R  E  V
 901 AGTGTTCCTGCCCAGTGAGGAGGAAATTTCCCTGTGCTGTGAATCCTTGTCCAGGGAGGT
 317  E  S  L  L  L  Q  G  L  P  P  R  V  L  P  L  H  P  D  C  G
 961 AGAGTCCTTGCTTCTCCAAGGGCTTCCACCACGAGTACTGCCCCTTCACCCAGACTGTGG
 337  R  A  V  Q  A  V  Y  E  D  M  D  A  R  K  V  V  V  T  H  W
1021 ACGAGCCGTTCAGGCTGTGTATGAGGACATGGATGCCCGAAAGGTTGTGGTCACTCACTG
 357  L  A  D  F  S  F  S  L  P  S  I  Q  H  V  I  D  S  G  L  E
1081 GCTGGCTGACTTCTCCTTCTCCCTCCCTTCCATCCAACATGTCATCGACTCAGGACTGGA
```

Figure 2M (continued)

```
 377  L  R  S  V  Y  N  P  R  I  R  A  E  F  Q  V  L  R  P  I  S
1141 GCTCCGAAGTGTTTACAATCCTAGGATCCGAGCAGAATTCCAAGTGTTGAGGCCAATCAG
 397  K  C  Q  A  E  A  R  R  L  R  A  R  G  F  P  P  G  S  C  L
1201 CAAGTGTCAGGCAGAGGCAAGACGATTGCGAGCAAGAGGGTTCCCACCAGGATCCTGCCT
 417  C  L  Y  P  K  S  F  L  E  L  E  A  P  P  L  P  Q  P  R  V
1261 CTGCCTGTATCCTAAGTCCTTCTTAGAACTAGAAGCTCCACCATTGCCACAACCCAGGGT
 437  C  E  E  N  L  S  S  L  V  L  L  L  K  R  R  Q  I  A  E  P
1321 GTGTGAGGAGAATCTGAGCTCCCTGGTGTTACTACTAAAAAGGAGACAGATTGCAGAGCC
 457  G  E  C  H  P  L  D  Q  P  A  P  E  A  L  M  Q  A  L  E  D
1381 AGGGGAGTGTCACTTCCTGGACCAGCCTGCTCCAGAAGCACTGATGCAAGCCCTGGAAGA
 477  L  D  Y  L  A  A  L  D  D  D  G  D  L  S  D  L  G  V  I  L
1441 TTTAGACTATCTGGCAGCCCTGGATGATGATGGGGACCTGTCAGATCTGGGTGTCATACT
 497  S  E  F  P  L  A  P  E  L  A  K  A  L  L  A  S  C  E  F  D
1501 ATCAGAATTCCCTCTGGCCCCTGAGCTGGCCAAAGCCCTGCTGGCCTCATGCGAGTTTGA
 517  C  V  D  E  M  L  T  L  A  A  M  L  T  A  A  P  G  F  T  R
1561 CTGTGTGGACGAGATGCTCACCCTGGCTGCCATGCTCACAGCTGCCCCTGGGTTTACCCG
 537  P  P  L  S  A  E  E  A  A  L  R  R  A  L  E  H  T  D  G  D
1621 TCCTCCACTCAGTGCAGAAGAAGCTGCCCTGCGTCGGGCCCTGGAACACACGGATGGTGA
 557  H  S  S  L  I  Q  V  Y  E  A  F  I  Q  S  G  A  D  E  A  W
1681 CCACAGTTCTCTGATCCAGGTGTATGAAGCCTTTATACAAAGTGGAGCAGATGAGGCTTG
 577  C  Q  A  R  G  L  N  W  A  A  L  C  Q  A  H  K  L  R  G  E
1741 GTGCCAGGCTCGAGGTCTGAATTGGGCAGCATTGTGCCAAGCCCATAAACTTCGGGGAGA
 597  L  L  E  L  M  Q  R  I  E  L  P  L  S  L  P  A  F  G  S  E
1801 ACTCCTAGAACTCATGCAACGAATTGAACTTCCCTTGTCCCTACCAGCCTTTGGCTCTGA
 617  Q  N  R  R  D  L  Q  K  A  L  V  S  G  Y  F  L  K  V  A  R
1861 GCAGAATCGCAGAGACCTTCAGAAAGCACTGGTGTCAGGATACTTTCTCAAGGTGGCCAG
 637  D  T  D  G  T  G  N  Y  L  L  L  T  H  K  H  V  A  Q  L  S
1921 AGACACAGACGGGACTGGAAATTACCTTCTCCTAACCCATAAGCATGTGGCCCAGCTCTC
 657  S  Y  C  C  Y  R  S  R  R  A  P  A  R  P  P  P  W  V  L  Y
1981 CTCATACTGCTGCTACCGAAGCCGCAGAGCTCCTGCCAGACCCCCACCATGGGTGCTCTA
 677  H  N  F  T  I  S  K  D  N  C  L  S  I  V  S  E  I  Q  P  Q
2041 CCACAATTTCACCATATCCAAAGACAACTGCCTTTCCATTGTTTCTGAGATTCAACCACA
 697  M  L  V  E  L  A  P  P  Y  F  L  S  N  L  P  P  S  E  S  R
2101 GATGCTGGTGGAATTGGCCCCTCCATACTTCCTGAGTAACTTGCCTCCCAGTGAGAGCAG
 717  D  L  L  N  Q  L  R  E  G  M  A  D  S  T  A  G  S  K  S  S
2161 AGACCTTCTGAACCAGCTAAGGGAAGGAATGGCAGATTCTACAGCAGGGAGCAAATCATC
 737  S  A  Q  E  F  R  D  P  C  V  L  Q  *
2221 CTCAGCCCAGGAGTTCAGAGATCCCTGTGTCCTGCAGTGAcctgcctgcctatggaatgg
2281 agctgggttcatctcatcacattagattatccctcagggtgacaccaaagcacccagaca
2341 gatttagaagcccaaagtttagggtcaaatgtaaaccctggaacctgagtcccaagaaat
2401 ggtagactgggaatggaaagaatggggtaaaccacagtctacatagggaaggactctttc
2461 cttagccttctcttattgattggagagggactgacatgctcctcattctcttaactttgc
2521 caaacccattcttgtactcccttgtgatctataaaagatttttctatgatgccaa
```

Figure 2N.1 The cDNA (SEQ ID NO:47) and amino acid sequence (SEQ ID NO:48) of 185P2C9 v.1. The start methionine is underlined. The open reading frame extends from nucleic acid 140-4063 including the stop codon.

```
   1 cacgggggaagcaggcgggcccccagcacccgggaggccgagctgaagctgcggctaaa
  61 gctggtggaggaggaagccaacatcttgggccggaagatcgtggagctggaggtggagaa
   1                    M  E  D  M  R  G  Q  Q  E  R  E  G  P  G
 121 ccgtggcctcaaggcagagATGGAGGACATGCGGGGCCAGCAGGAGCGGGAGGGCCCGGG
  15  R  D  H  A  P  S  I  P  T  S  P  F  G  D  S  L  E  S  S  T
 181 TCGGGACCACGCACCCAGCATTCCTACCTCACCCTTCGGTGACTCCCTGGAGTCCTCCAC
  35  E  L  R  R  H  L  Q  F  V  E  E  E  A  E  L  L  R  R  S  I
 241 TGAGCTCCGCCGCCACCTGCAGTTTGTAGAAGAGGAAGCGGAGTTGCTCCGGAGGTCCAT
  55  S  E  I  E  D  H  N  R  Q  L  T  H  E  L  S  K  F  K  F  E
 301 CTCCGAGATCGAAGACCACAACCGGCAACTGACCCACGAGCTCAGCAAGTTTAAGTTTGA
  75  P  P  R  E  P  G  W  L  G  E  G  A  S  P  G  A  G  G  G  A
 361 GCCTCCCCGGGAGCCGGGCTGGCTAGGAGAGGGTGCAAGTCCTGGTGCCGGGGGTGGGGC
  95  P  L  Q  E  E  L  K  S  A  R  L  Q  I  S  E  L  S  G  K  V
 421 CCCCCTGCAGGAGGAGCTGAAGTCAGCCAGGCTGCAGATCAGCGAGCTCAGCGGCAAGGT
 115  L  K  L  Q  H  E  N  H  A  L  L  S  N  I  Q  R  C  D  L  A
 481 GCTCAAACTGCAGCACGAGAACCACGCGCTGCTGTCCAACATCCAGCGCTGCGACCTGGC
 135  A  H  L  G  L  R  A  P  S  P  R  D  S  D  A  E  S  D  A  G
 541 AGCCCACCTGGGGCTGCGTGCCCCCAGTCCCCGGGACAGCGATGCCGAGAGTGATGCGGG
 155  K  K  E  S  D  G  E  E  S  R  L  P  Q  P  K  R  E  G  P  V
 601 CAAGAAGGAGAGTGATGGGGAGGAGAGCCGCCTGCCCCAGCCCAAGCGGGAAGGGCCTGT
 175  G  G  E  S  D  S  E  E  M  F  E  K  T  S  G  F  G  S  G  K
 661 TGGCGGGGAGAGTGACTCGGAGGAAATGTTTGAGAAGACGTCGGGCTTCGGGAGCGGGAA
```

Figure 2N.1 (continued)

```
 195 P  S  E  A  S  E  P  C  P  T  E  L  L  K  A  R  E  D  S  E
 721 GCCATCGGAGGCCAGCGAGCCATGCCCCACGGAGCTCCTGAAGGCCCGGGAGGACTCTGA
 215 Y  L  V  T  L  K  H  E  A  Q  R  L  E  R  T  V  E  R  L  I
 781 GTACCTAGTGACCCTAAAACACGAGGCCCAGCGGCTAGAGCGGACGGTGGAGCGCCTCAT
 235 T  D  T  D  S  F  L  H  D  A  G  L  R  G  G  A  P  L  P  G
 841 CACGGACACCGACAGCTTCCTCCATGATGCGGGGCTGCGGGGTGGTGCGCCCTTACCGGG
 255 P  G  L  Q  G  E  E  E  Q  G  E  G  D  Q  Q  E  P  Q  L  L
 901 GCCTGGCCTCCAGGGCGAAGAGGAGCAGGGTGAGGGGGACCAGCAGGAGCCCCAGCTGCT
 275 G  T  I  N  A  K  M  K  A  F  K  K  E  L  Q  A  F  L  E  Q
 961 GGGGACCATCAACGCCAAGATGAAGGCTTTCAAGAAAGAGCTGCAGGCCTTCCTGGAGCA
 295 V  N  R  I  G  D  G  L  S  P  L  P  H  L  T  E  S  S  S  F
1021 GGTGAACCGCATTGGGGATGGCCTATCCCCCTTGCCCCACCTCACAGAGTCCTCTAGCTT
 315 L  S  T  V  T  S  V  S  R  D  S  P  I  G  N  L  G  K  E  L
1081 CCTCTCCACTGTGACTTCCGTGTCCCGGGACTCCCCCATCGGGAACCTGGGGAAGGAGCT
 335 G  P  D  L  Q  S  R  L  K  E  Q  L  E  W  Q  L  G  P  A  R
1141 GGGCCCAGACTTGCAGTCCAGACTGAAAGAGCAGCTGGAGTGGCAGCTCGGGCCGGCCCG
 355 G  D  E  R  E  S  L  R  L  R  A  A  R  E  L  H  R  R  A  D
1201 AGGGGACGAGCGGGAGAGCCTGCGCCTCCGAGCCGCGCGGGAGCTGCACCGCCGCGCAGA
 375 G  D  T  G  S  H  G  L  G  G  Q  T  C  F  S  L  E  M  E  E
1261 CGGGGACACCGGGAGCCACGGGCTGGGAGGCCAGACCTGCTTCAGCCTGGAGATGGAGGA
 395 E  H  L  Y  A  L  R  W  K  E  L  E  M  H  S  L  A  L  Q  N
1321 GGAGCACCTCTATGCCTTGAGGTGGAAAGAACTGGAAATGCACAGCCTGGCTTTGCAAAA
 415 T  L  H  E  R  T  W  S  D  E  K  N  L  M  Q  Q  E  L  R  S
1381 CACCCTCCATGAGCGAACCTGGAGTGATGAGAAGAATCTGATGCAGCAGGAGCTCCGGTC
 435 L  K  Q  N  I  F  L  F  Y  V  K  L  R  W  L  L  K  H  W  R
1441 CTTGAAGCAGAACATTTTCCTCTTCTACGTCAAACTCAGGTGGCTGCTGAAACACTGGCG
 455 Q  G  K  Q  M  E  E  E  G  E  E  F  T  E  G  E  H  P  E  T
1501 GCAAGGGAAGCAGATGGAGGAGGAAGGAGAGGAGTTCACTGAGGGTGAACATCCAGAGAC
 475 L  S  R  L  G  E  L  G  V  Q  G  G  H  Q  A  D  G  P  D  H
1561 CCTCTCCAGGCTCGGGGAGCTTGGAGTCCAGGGGGGTCACCAGGCGGATGGCCCAGACCA
 495 D  S  D  R  G  C  G  F  P  V  G  E  H  S  P  H  S  R  V  Q
1621 CGACAGTGACCGAGGCTGTGGCTTTCCAGTGGGGGAGCACTCCCCACACTCCCGGGTGCA
 515 I  G  D  H  S  L  R  L  Q  T  A  D  R  G  Q  P  H  K  Q  V
1681 GATTGGAGATCACAGCTTGCGGCTGCAGACCGCGGACAGGGGACAGCCCCACAAACAGGT
 535 V  E  N  Q  Q  L  F  S  A  F  K  A  L  L  E  D  F  R  A  E
1741 GGTGGAAAACCAGCAGCTGTTCAGCGCCTTCAAGGCCTTGCTGGAGGACTTCCGTGCGGA
 555 L  R  E  D  E  R  A  R  L  R  L  Q  Q  Q  Y  A  S  D  K  A
1801 GCTGCGGGAGGATGAGCGTGCCCGACTACGGCTGCAGCAGCAATATGCCAGCGACAAGGC
 575 A  W  D  V  E  W  A  V  L  K  C  R  L  E  Q  L  E  E  K  T
1861 GGCCTGGGACGTGGAGTGGGCCGTGCTCAAGTGCCGTCTGGAACAGCTGGAAGAGAAGAC
 595 E  N  K  L  G  E  L  G  S  S  A  E  S  K  G  A  L  K  K  E
1921 TGAGAACAAGTTGGGAGAACTAGGCTCCTCCGCTGAGAGCAAGGGGGCCTTGAAGAAGGA
 615 R  E  V  H  Q  K  L  L  A  D  S  H  S  L  V  M  D  L  R  W
1981 GAGAGAGGTGCACCAGAAGCTCCTGGCAGACAGTCACAGCCTGGTCATGGACCTGCGCTG
 635 Q  I  H  H  S  E  K  N  W  N  R  E  K  V  E  L  L  D  R  L
2041 GCAGATCCATCACAGCGAGAAGAACTGGAACCGGGAGAAGGTGGAACTTCTCGACCGCCT
 655 D  R  D  R  Q  E  W  E  R  Q  K  K  E  F  L  W  R  I  E  Q
2101 GGACAGAGATCGGCAGGAGTGGGAGCGGCAGAAGAAGGAATTCTTGTGGAGGATAGAGCA
 675 L  Q  K  E  N  S  P  R  R  G  G  S  F  L  C  D  Q  K  D  G
2161 GTTGCAGAAAGAGAACAGTCCCCGGAGAGGTGGCAGTTTCCTCTGTGATCAAAAAGACGG
 695 N  V  R  P  F  P  H  Q  G  S  L  R  M  P  R  P  V  A  M  W
2221 CAACGTTCGCCCCTTTCCCCACCAGGGAAGCCTCCGCATGCCCCGTCCAGTGGCCATGTG
 715 P  C  A  D  A  D  S  I  P  F  E  D  R  P  L  S  K  L  K  E
2281 GCCTTGTGCAGATGCTGACTCCATCCCGTTTGAAGACCGGCCGCTGTCCAAGCTGAAGGA
 735 S  D  R  C  S  A  S  E  N  L  Y  L  D  A  L  S  L  D  D  E
2341 GTCGGACAGGTGCTCGGCCAGTGAGAATCTCTACCTGGATGCCTTGTCCCTGGATGACGA
 755 P  E  E  P  P  A  H  R  P  E  R  E  F  R  N  R  L  P  E  E
2401 GCCAGAAGAGCCACCAGCCCACAGGCCCGAGAGGGAGTTCAGGAACCGCCTCCCTGAGGA
 775 E  E  N  H  K  G  N  L  Q  R  A  V  S  V  S  S  M  S  E  F
2461 AGAAGAAAATCACAAAGGAAATCTTCAAAGGGCGGTGTCCGTGTCCTCCATGTCTGAGTT
 795 Q  R  L  M  D  I  S  P  F  L  P  E  K  G  L  P  S  T  S  S
2521 CCAGCGTCTAATGGACATCTCCCCCTTCCTGCCTGAGAAGGGCCTGCCGTCCACCAGCAG
 815 K  E  D  V  T  P  P  L  S  P  D  D  L  K  Y  I  E  E  F  N
2581 CAAGGAGGATGTCACCCCACCCCTGTCTCCAGACGACCTCAAGTACATCGAGGAGTTCAA
 835 K  S  W  D  Y  T  P  N  R  G  H  N  G  G  G  P  D  L  W  A
2641 CAAGAGCTGGGACTACACACCCAACAGGGGCCACAATGGTGGGGGCCCGGACCTTTGGGC
 855 D  R  T  E  V  G  R  A  G  H  E  D  S  T  E  P  F  P  D  S
2701 CGACAGGACCGAGGTGGGGCGGGCAGGGCACGAGGACAGCACAGAGCCTTTCCCCGACTC
 875 S  W  Y  L  T  T  S  V  T  M  T  T  D  T  M  T  S  P  E  H
2761 CTCCTGGTACCTAACCACAAGTGTCACCATGACCACGGACACCATGACCAGCCCAGAGCA
 895 C  Q  K  Q  P  L  R  S  H  V  L  T  E  Q  S  G  L  R  V  L
```

Figure 2N.1 (continued)

```
2821 CTGCCAGAAGCAGCCACTGCGGAGCCACGTCCTCACCGAGCAGTCGGGGTTGCGCGTGTT
 915  H  S  P  P  A  V  R  R  V  D  S  I  T  A  A  G  G  E  G  P
2881 ACACAGCCCGCCTGCCGTGCGCAGGGTCGACAGCATCACGGCGGCAGGTGGTGAGGGTCC
 935  F  P  T  S  R  A  R  G  S  P  G  D  T  K  G  G  P  P  E  P
2941 CTTTCCCACAAGCAGAGCCAGAGGGAGCCCGGGAGACACCAAGGGGGGCCCTCCAGAACC
 955  M  L  S  R  W  P  C  T  S  P  R  H  S  R  D  Y  V  E  G  A
3001 CATGCTCAGCAGGTGGCCTTGCACCTCCCCCAGGCACTCCCGGGACTATGTGGAGGGGGC
 975  R  R  P  L  D  S  P  L  C  T  S  L  G  F  A  S  P  L  H  S
3061 ACGGCGCCCCCTTGATAGTCCCCTCTGTACCTCCCTGGGGTTTGCCTCCCCACTGCACAG
 995  L  E  M  S  K  N  L  S  D  D  M  K  E  V  A  F  S  V  R  N
3121 CCTGGAGATGTCCAAGAACTTGAGTGATGACATGAAGGAGGTGGCCTTCTCTGTCAGGAA
1015  A  I  C  S  G  P  G  E  L  Q  V  K  D  M  A  C  Q  T  N  G
3181 TGCCATCTGCTCCGGCCCTGGCGAGCTGCAAGTCAAGGACATGGCCTGCCAGACCAATGG
1035  S  R  T  M  G  T  Q  T  V  Q  T  I  S  V  G  L  Q  T  E  A
3241 GTCCCGGACGATGGGGACCCAGACTGTTCAGACCATCAGTGTGGGCTTGCAGACTGAAGC
1055  L  R  G  S  G  V  T  S  S  P  H  K  C  L  T  P  K  A  G  G
3301 CCTGCGTGGCAGCGGTGTCACCAGCAGCCCCCACAAGTGTCTCACTCCAAAGGCTGGGGG
1075  G  A  T  P  V  S  S  P  S  R  S  L  R  S  R  Q  V  A  P  A
3361 CGGTGCTACACCCGTGTCGTCTCCTTCCCGGAGCCTTAGGAGCAGACAGGTGGCCCCTGC
1095  I  E  K  V  Q  A  K  F  E  R  T  C  C  S  P  K  Y  G  S  P
3421 CATCGAGAAGGTGCAGGCCAAGTTTGAACGCACATGCTGCTCCCCCAAGTATGGTTCTCC
1115  K  L  Q  R  K  P  L  P  K  A  D  Q  P  N  N  R  T  S  P  G
3481 CAAGCTGCAGAGGAAGCCCCTCCCCAAAGCCGACCAGCCAAATAACAGGACGTCACCAGG
1135  M  A  Q  K  G  Y  S  E  S  A  W  A  R  S  T  T  T  R  E  S
3541 GATGGCCCAGAAAGGGTACAGTGAGTCAGCCTGGGCCCGCTCCACCACCACAAGGGAGAG
1155  P  V  H  T  T  I  N  D  G  L  S  S  L  F  N  I  I  D  H  S
3601 CCCCGTGCACACCACCATTAATGATGGCCTCTCCAGCCTCTTCAACATCATTGACCACAG
1175  P  V  V  Q  D  P  F  Q  K  G  L  R  A  G  S  R  S  R  S  A
3661 CCCCGTGGTGCAGGACCCCTTCCAGAAGGGGCTGCGGGCCGGCAGTCGGTCTCGCTCAGC
1195  E  P  R  P  E  L  G  P  G  Q  E  T  G  T  N  S  R  G  R  S
3721 AGAGCCCCGACCAGAGCTGGGCCCAGGCCAGGAAACAGGCACCAATTCCCGAGGAAGGTC
1215  P  S  P  I  G  V  G  S  E  M  C  R  E  E  G  G  E  G  T  P
3781 GCCTAGCCCCATTGGGGTGGGGTCAGAGATGTGCAGGGAGGAAGGGGGAGAGGGCACGCC
1235  V  K  Q  D  L  S  A  P  P  G  Y  T  L  T  E  N  V  A  R  I
3841 AGTGAAGCAGGACTTATCTGCTCCCCCTGGCTACACCCTCACTGAGAACGTGGCCCGGAT
1255  L  N  K  K  L  L  E  H  A  L  K  E  E  R  R  Q  A  A  H  G
3901 CCTCAACAAGAAGCTGCTGGAACATGCCTTAAAGGAGGAGAGGAGGCAGGCTGCCCACGG
1275  P  P  G  L  H  S  D  S  H  S  L  G  D  T  A  E  P  G  P  M
3961 GCCCCCGGGTCTCCACAGTGACAGCCACTCGCTGGGGGACACAGCCGAGCCAGGGCCCAT
1295  E  N  Q  T  V  L  L  T  A  P  W  G  L  *
4021 GGAGAACCAAACTGTCTTGCTAACTGCCCCCTGGGGACTCTAGccctgcccgcctcacgc
4081 tgaactaccttgttctgcactagctccatccctagagccctgcttctccaggcccgagag
4141 accagcaaaccgtcgccctccgtcccgttgggccccacattccccactgcctcacagcc
4201 tcagtcacccggagacccgacgtccttggaggagcatggtggcgaggagccgcccgagga
4261 gcagccacaccgagatgcaagcttgcatggattatcacagtataattcactgtaatttgc
4321 ataaccacaccatcaccatgaacaaaactctgcccaacaggagagatctagttttctcaa
4381 ggtcaaagaatgtttttaaaaacacaaagctgctgaatgttcaacctgtgaaactgaga
4441 tgtttctagaatgaaacagtaaatgtgcctgtaataacttaatttttttcatagctcaga
4501 aaactatttttgtctccatctttttacacacagtatattaaacgaaaaggtaaataagg
4561 tataaatagatttaaaaaataaaagttttaaaaaatgtacattttaagagattctgaaca
4621 ccctcgctgtcaatacctgactgcctctgttaaatttgcactgttacattttggttcagt
4681 ttatttccatgttgaattagagtggattaagttaattttatttgtcagtgttactgttt
4741 tttacgaatttttaatgcttcagactgtctgattcagtgaacttttgtagtgaaaaag
4801 ccatgaagccagtagacaagacagatattctgtatgctggaggggatacaggatgatttt
4861 gaaaaggtacaaagtcctcagtgggcttagaaaattcactgtatgatccttatattatcc
4921 tacttggcttgcacgtcttcgggtgcatgtatataccgctactgtgtcctcgccatcacc
4981 taaatgtgactcagtctgttccactgtaatatgttgtgaatttccttgtactgtactttt
5041 attgttggtcttcttgcatcgatgatccaacagcaacaccatttttaaattattgtgaaa
5101 agattaactggcaatgtacagagtttactcaaagttttcttaagggaaaacactacaaaa
5161 agtcacaaggataccaaatggaaacacatgatgatgcctctgggtctgtatgagaccgtg
5221 atgaagtagaaataaagcccttctgagatggc
```

Figure 2N.2 The cDNA (SEQ ID NO:49) and amino acid sequence (SEQ ID NO:50) of 185P2C9 v.2 clone 1. The start methionine is underlined. The open reading frame extends from nucleic acid 140-3568 including the stop codon.

```
   1 cacgggggaagcaggcgggcccccagcacccgggaggccgagctgaagctgcggctaaa
  61 gctggtggaggaggaagccaacatcttgggccggaagatcgtggagctggaggtggagaa
   1                    M  E  D  T  R  G  Q  Q  E  R  E  G  P  G
 121 ccgtggcctcaaggcagagATGGAGGACACGCGGGGCCAGCAGGAGCGGGAGGGCCCGGG
```

Figure 2N.2 (continued)

```
  15 R  D  H  A  P  S  I  P  T  S  P  F  G  D  S  L  E  S  S  T
 181 TCGGGACCACGCACCCAGCATTCCTACCTCACCCTTCGGTGACTCCCTGGAGTCCTCCAC
  35 E  L  R  R  H  L  Q  F  V  E  E  E  A  E  L  L  R  R  S  I
 241 TGAGCTCCGCCGCCACCTGCAGTTTGTAGAAGAGGAAGCGGAGTTGCTCCGGAGGTCCAT
  55 S  E  I  E  D  H  N  R  Q  L  T  H  E  L  S  K  F  K  F  E
 301 CTCCGAGATCGAAGACCACAACCGGCAACTGACCCACGAGCTCAGCAAGTTTAAGTTTGA
  75 P  P  R  E  P  G  W  L  G  E  G  A  S  P  G  A  G  G  G  A
 361 GCCTCCCCGGGAGCCGGGCTGGCTAGGAGAGGGTGCAAGTCCTGGTGCCGGGGGTGGGGC
  95 P  L  Q  E  E  L  K  S  A  R  L  Q  I  S  E  L  S  G  K  V
 421 CCCCCTGCAGGAGGAGCTGAAGTCAGCCAGGCTGCAGATCAGCGAGCTCAGCGGCAAGGT
 115 L  K  L  Q  H  E  N  H  A  L  L  S  N  I  Q  R  C  D  L  A
 481 GCTCAAACTGCAGCACGAGAACCACGCGCTGCTGTCCAACATCCAGCGCTGCGACCTGGC
 135 A  H  L  G  L  R  A  P  S  P  R  D  S  D  A  E  S  D  A  G
 541 AGCCCACCTGGGGCTGCGTGCCCCCAGTCCCCGGGACAGCGATGCCGAGAGTGATGCGGG
 155 K  K  E  S  D  G  E  E  S  R  L  P  Q  P  K  R  E  G  P  V
 601 CAAGAAGGAGAGTGATGGGGAGGAGAGCCGCCTGCCCCAGCCCAAGCGGGAAGGGCCTGT
 175 G  G  E  S  D  S  E  E  M  F  E  K  T  S  G  F  G  S  G  K
 661 TGGCGGGGAGAGTGACTCGGAGGAGATGTTTGAGAAGACGTCGGGCTTCGGGAGCGGGAA
 195 P  S  E  A  S  E  P  C  P  T  E  L  L  K  A  R  E  D  S  E
 721 GCCATCGGAGGCCAGCGAGCCATGCCCCACGGAGCTCCTGAAGGCCCGGGAGGACTCTGA
 215 Y  L  V  T  L  K  H  E  A  Q  R  L  E  R  T  V  E  R  L  I
 781 GTACCTAGTGACCCTAAAACACGAGGCCCAGCGGCTAGAGCGGACGGTGGAGCGCCTCAT
 235 T  D  T  D  S  F  L  H  D  A  G  L  R  G  G  A  P  L  P  G
 841 CACGGACACCGACAGCTTCCTCCATGATGCGGGGCTGCGGGGTGGTGCGCCCTTACCGGG
 255 P  G  L  Q  G  E  E  E  Q  G  E  G  D  Q  Q  E  P  Q  L  L
 901 GCCTGGCCTCCAGGGCGAAGAGGAGCAGGGTGAGGGGGACCAGCAGGAGCCCCAGCTGCT
 275 G  T  I  N  A  K  M  K  A  F  K  K  E  L  Q  A  F  L  Q  Q
 961 GGGGACCATCAACGCCAAGATGAAGGCTTTCAAGAAAGAGCTGCAGGCCTTCCTGCAGCA
 295 V  N  R  I  G  D  G  L  S  P  L  P  H  L  T  E  S  S  S  F
1021 GGTGAACCGCATTGGGGATGGCCTATCCCCCTTGCCCCACCTCACAGAGTCCTCTAGCTT
 315 L  S  T  V  T  S  V  S  R  D  S  P  I  G  N  L  G  K  E  L
1081 CCTCTCCACTGTGACTTCCGTGTCCCGGGACTCCCCCATCGGGAACCTGGGGAAGGAGCT
 335 G  P  D  L  Q  S  R  L  K  E  Q  L  E  W  Q  L  G  P  A  Q
1141 GGGCCCAGACTTGCAGTCCAGACTGAAAGAGCAGCTGGAGTGGCAGCTCGGGCCGGCCCA
 355 G  D  E  R  E  S  L  R  L  R  A  A  R  E  L  H  R  R  A  D
1201 AGGGGACGAGCGGGAGAGCCTGCGCCTCCGAGCCGCGCGGGAGCTGCACCGCCGCGCAGA
 375 G  D  T  G  S  H  G  L  G  G  Q  T  C  F  S  L  E  M  E  E
1261 CGGGGACACCGGGAGCCACGGGCTGGGAGGCCAGACCTGCTTCAGCCTGGAGATGGAGGA
 395 E  H  L  Y  A  L  R  W  K  E  L  E  M  H  S  L  A  L  Q  N
1321 GGAGCACCTCTATGCCTTGAGGTGGAAAGAACTGGAAATGCACAGCCTGGCTTTGCAAAA
 415 T  L  H  E  R  T  W  S  D  E  K  N  L  M  Q  Q  E  L  R  S
1381 CACCCTCCATGAGCGAACCTGGAGTGATGAGAAGAATCTGATGCAGCAGGAGCTCCGGTC
 435 L  K  Q  N  I  F  L  F  Y  V  K  L  R  W  L  L  K  H  W  R
1441 CTTGAAGCAGAACATTTTCCTCTTCTACGTCAAACTCAGGTGGCTGCTGAAACACTGGCG
 455 Q  G  K  Q  M  E  E  E  G  E  E  F  T  E  G  E  H  P  E  T
1501 GCAAGGGAAGCAGATGGAGGAGGAAGGAGAGGAGTTCACTGAGGGTGAACATCCAGAGAC
 475 L  S  R  L  G  E  L  G  V  Q  G  G  H  Q  A  D  G  P  D  H
1561 CCTCTCCAGGCTCGGGGAGCTTGGAGTCCAGGGGGGTCACCAGGCGGATGGCCCAGACCA
 495 D  S  D  R  G  C  G  F  P  V  G  E  H  S  P  H  S  R  V  Q
1621 CGACAGTGACCGAGGCTGTGGCTTTCCAGTGGGGGAGCACTCCCCACACTCCCGGGTGCA
 515 I  G  D  H  S  L  R  L  Q  T  A  D  R  G  Q  P  H  K  Q  V
1681 GATTGGAGATCACAGCTTGCGGCTGCAGACCGCGGACAGGGGACAGCCCCACAAACAGGT
 535 V  E  N  Q  Q  L  F  S  A  F  K  A  L  L  E  D  F  R  A  E
1741 GGTGGAAAACCAGCAGCTGTTCAGCGCCTTCAAGGCCTTGCTGGAGGACTTCCGTGCGGA
 555 L  R  E  D  E  R  A  R  L  R  L  Q  Q  Q  Y  A  S  D  K  A
1801 GCTGCGGGAGGATGAGCGTGCCCGACTACGGCTGCAGCAGCAATATGCCAGCGACAAGGC
 575 A  W  D  V  E  W  A  V  L  K  C  R  L  E  Q  L  E  E  K  T
1861 GGCCTGGGACGTGGAGTGGGCCGTGCTCAAGTGCCGTCTGGAACAGCTGGAAGAGAAGAC
 595 E  N  K  L  G  E  L  G  S  S  A  E  S  K  G  A  L  K  K  E
1921 TGAGAACAAGTTGGGAGAACTAGGCTCCTCCGCTGAGAGCAAGGGGGCCTTGAAGAAGGA
 615 R  E  V  H  Q  K  L  L  A  D  S  H  S  L  V  M  D  L  R  W
1981 GAGAGAGGTGCACCAGAAGCTCCTGGCAGACAGTCACAGCCTGGTCATGGACCTGCGCTG
 635 Q  I  H  H  S  E  K  N  W  N  R  E  K  V  E  L  L  D  R  L
2041 GCAGATCCATCACAGCGAGAAGAACTGGAACCGGGAGAAGGTGGAACTTCTCGACCGCCT
 655 D  R  D  R  Q  E  W  E  R  Q  K  K  E  F  L  W  R  I  E  Q
2101 GGACAGAGATCGGCAGGAGTGGGAGCGGCAGAAGAAGGAATTCTTGTGGAGGATAGAGCA
 675 L  Q  K  E  N  S  P  R  R  G  G  S  F  L  C  D  Q  K  D  G
2161 GTTGCAGAAAGAGAACAGTCCCCGGAGAGGTGGCAGTTTCCTCTGTGATCAAAAAGACGG
 695 N  V  R  P  F  P  H  Q  G  S  L  R  M  P  R  P  V  A  M  W
2221 CAACGTTCGCCCCTTTCCCCACCAGGGAAGCCTCCGCATGCCCCGTCCAGTGGCCATGTG
 715 P  C  A  D  A  D  S  I  P  F  E  D  R  P  L  S  K  L  K  E
```

Figure 2N.2 (continued)

```
2281 GCCTTGTGCAGATGCTGACTCCATCCCGTTTGAAGACCGGCCGCTGTCCAAGCTGAAGGA
 735  S  D  R  C  S  A  S  E  N  L  Y  L  D  A  L  S  L  D  D  E
2341 GTCGGACAGGTGCTCGGCCAGTGAGAATCTCTACCTGGATGCCTTGTCCCTGGATGACGA
 755  P  E  E  P  P  A  H  R  P  E  R  E  F  R  N  R  L  P  E  E
2401 GCCAGAAGAGCCACCAGCCCACAGGCCCGAGAGGGAGTTCAGGAACCGCCTCCCTGAGGA
 775  E  E  N  H  K  G  N  L  Q  R  A  V  S  V  S  S  M  S  E  F
2461 AGAAGAAAATCACAAAGGAAATCTTCAAAGGGCGGTGTCCGTGTCCTCCATGTCTGAGTT
 795  Q  R  L  M  D  I  S  P  F  L  P  E  K  G  L  P  S  T  S  S
2521 CCAGCGTCTAATGGACATCTCCCCCTTCCTGCCTGAGAAGGGCCTGCCGTCCACCAGCAG
 815  K  E  D  V  T  P  P  L  S  P  D  D  L  K  Y  I  E  E  F  N
2581 CAAGGAGGATGTCACCCCACCCCTGTCTCCAGACGACCTCAAGTACATCGAGGAGTTCAA
 835  K  S  W  D  Y  T  P  N  R  G  H  N  G  G  G  P  D  L  W  A
2641 CAAGAGCTGGGACTACACACCCAACAGGGGCCACAATGGTGGGGGCCCGGACCTTTGGGC
 855  D  R  T  E  V  G  R  A  G  H  E  D  S  T  E  P  F  P  D  S
2701 CGACAGGACCGAGGTGGGGCGGGCAGGGCACGAGGACAGCACAGAGCCTTTCCCCGACTC
 875  S  W  Y  L  T  T  S  V  T  M  T  T  D  T  M  T  S  P  E  H
2761 CTCCTGGTACCTAACCACAAGTGTCACCATGACCACGGACACCATGACCAGCCCAGAGCA
 895  C  Q  K  Q  P  L  R  S  H  V  L  T  E  Q  S  G  L  R  V  L
2821 CTGCCAGAAGCAGCCACTGCGGAGCCACGTCCTCACCGAGCAGTCGGGGTTGCGCGTGTT
 915  H  S  P  P  A  V  R  R  V  D  S  I  T  A  A  G  G  E  G  P
2881 ACACAGCCCGCCTGCCGTGCGCAGGGTCGACAGCATCACGGCGGCAGGTGGTGAGGGTCC
 935  F  P  T  S  R  A  R  G  S  P  G  D  T  K  G  G  P  P  E  P
2941 CTTTCCCACAAGCAGAGCCAGAGGGAGCCCGGGAGACACCAAGGGGGGCCCTCCAGAACC
 955  M  L  S  R  W  P  C  T  S  P  R  H  S  R  D  Y  V  E  G  A
3001 CATGCTCAGCAGGTGGCCTTGCACCTCCCCCAGGCACTCCCGGGACTATGTGGAGGGGGC
 975  R  R  P  L  D  S  P  L  C  T  S  L  G  F  A  S  P  L  H  S
3061 ACGGCGCCCCCTTGATAGTCCCCTCTGTACCTCCCTGGGGTTTGCCTCCCCACTGCACAG
 995  L  E  M  S  K  N  L  S  D  D  M  K  E  V  A  F  S  V  R  N
3121 CCTGGAGATGTCCAAGAACTTGAGTGATGACATGAAGGAGGTGGCCTTCTCTGTCAGGAA
1015  A  I  C  S  G  P  G  E  L  Q  V  K  D  M  A  C  Q  T  N  G
3181 TGCCATCTGCTCCGGCCCTGGCGAGCTGCAAGTCAAGGACATGGCCTGCCAGACCAATGG
1035  S  R  T  M  G  T  Q  T  V  Q  T  I  S  V  G  L  Q  T  E  A
3241 GTCCCGGACGATGGGGACCCAGACTGTTCAGACCATCAGTGTGGGCTTGCAGACTGAAGC
1055  L  R  G  S  G  V  T  S  S  P  H  K  C  L  T  P  K  A  G  G
3301 CCTGCGTGGCAGCGGTGTCACCAGCAGCCCCCACAAGTGTCTCACTCCAAAGGCTGGGGG
1075  G  A  T  P  V  S  S  P  S  R  S  L  R  S  R  Q  V  A  P  A
3361 CGGTGCTACACCCGTGTCGTCTCCTTCCCGGAGCCTTAGGAGCAGACAGGTGGCCCCTGC
1095  I  E  K  V  Q  A  K  F  E  R  T  C  C  S  P  K  Y  G  S  P
3421 CATCGAGAAGGTGCAGGCCAAGTTTGAACGCACATGCTGCTCCCCCAAGTATGGTTCTCC
1115  K  L  Q  R  K  P  L  P  K  A  D  Q  P  N  N  R  P  G  N  R
3481 CAAGCTGCAGAGGAAGCCCCTCCCCAAAGCCGACCAGCCAAATAACAGGCCAGGAAACAG
1135  H  Q  F  P  R  K  V  A  *
3541 GCACCAATTCCCGAGGAAGGTCGCCTAGccccattggggtggggtcagagatgtgcaggg
3601 aggaagggggagagggcacgccagtgaagcaggacttatctgctccccctggctacaccc
3661 tcactgagaacgtggcccggatcctcaacaagaagctgctggaacatgccttaaaggagg
3721 agaggaggcaggctgcccacgggcccccgggtctccacagtgacagccactcgctggggg
3781 acacagccgagccagggcccatggaggaactaccttgttctgcactagctcc
```

Figure 2N.3 The cDNA (SEQ ID NO:51) and amino acid sequence (SEQ ID NO:52) of 185P2C9 v.3 clone 2. The start methionine is underlined. The open reading frame extends from nucleic acid 140-4078 including the stop codon.

```
   1 cacgggggaagcaggcgggccccccagcacccgggaggccgagctgaagctgcggctaaa
  61 gctggtggaggaggaagccaacatcttgggccggaagatcgtggagctggaggtggagaa
   1                    M  E  D  T  R  G  Q  Q  E  R  E  G  P  G
 121 ccgtggcctcaaggcagagATGGAGGACACGCGGGGCCAGCAGGAGCGGGAGGGCCCGGG
  15  R  D  H  A  P  S  I  P  T  S  P  F  G  D  S  L  E  S  S  T
 181 TCGGGACCACGCACCCAGCATTCCTACCTCACCCTTCGGTGACTCCCTGGAGTCCTCCAC
  35  E  L  R  R  H  L  Q  F  V  E  E  E  A  E  L  L  R  R  S  I
 241 TGAGCTCCGCCGCCACCTGCAGTTTGTAGAAGAGGAAGCGGAGTTGCTCCGGAGGTCCAT
  55  S  E  I  E  D  H  N  R  Q  L  T  H  E  L  S  K  F  K  F  E
 301 CTCCGAGATCGAAGACCACAACCGGCAACTGACCCACGAGCTCAGCAAGTTTAAGTTTGA
  75  P  P  R  E  P  G  W  L  G  E  G  A  S  P  G  A  G  G  G  A
 361 GCCTCCCCGGGAGCCGGGCTGGCTAGGAGAGGGTGCAAGTCCTGGTGCCGGGGGTGGGGC
  95  P  L  Q  E  E  L  K  S  A  R  L  Q  I  S  E  L  S  G  K  V
 421 CCCCCTGCAGGAGGAGCTGAAGTCAGCCAGGCTGCAGATCAGCGAGCTCAGCGGCAAGGT
 115  L  K  L  Q  H  E  N  H  A  L  L  S  N  I  Q  R  C  D  L  A
 481 GCTCAAACTGCAGCACGAGAACCACGCGCTGCTGTCCAACATCCAGCGCTGCGACCTGGC
 135  A  H  L  G  L  R  A  P  S  P  R  D  S  D  A  E  S  D  A  G
 541 AGCCCACCTGGGGCTGCGTGCCCCCAGTCCCCGGGACAGCGATGCCGAGAGTGATGCGGG
```

Figure 2N.3 (continued)

155 K K E S D G E E S R L P Q P K W E G P V
601 CAAGAAGGAGAGTGATGGGGAGGAGAGCCGCCTGCCCCAGCCCAAGTGGGAAGGGCCTGT
175 G G E S D S E E M F E K T S G F G S G K
661 TGGCGGGGAGAGTGACTCGGAGGAGATGTTTGAGAAGACGTCGGGCTTCGGGAGCGGGAA
195 P S E A S E P C P T E L L K A R E D S E
721 GCCATCGGAGGCCAGCGAGCCATGCCCCACGGAGCTCCTGAAGGCCCGGGAGGACTCTGA
215 Y L V T L K H E A Q R L E R T V E R L I
781 GTACCTAGTGACCCTAAAACACGAGGCCCAGCGGCTAGAGCGGACGGTGGAGCGCCTCAT
235 T D T D S F L H D A G L R G G A P L P G
841 CACGGACACCGACAGCTTCCTCCATGATGCGGGGCTGCGGGGTGGTGCGCCCTTACCGGG
255 P G L Q G E E E Q G E G D Q Q E P Q L L
901 GCCTGGCCTCCAGGGCGAAGAGGAGCAGGGTGAGGGGGACCAGCAGGAGCCCCAGCTGCT
275 G T I N A K M K A F K K E L Q A F L E Q
961 GGGGACCATCAACGCCAAGATGAAGGCTTTCAAGAAAGAGCTGCAGGCCTTCCTGGAGCA
295 V N R I G D G L S P L P H L T E S S S F
1021 GGTGAACCGCATTGGGGATGGCCTATCCCCCTTGCCCCACCTCACAGAGTCCTCTAGCTT
315 L S T V T S V S R D S P I G N L G K E L
1081 CCTCTCCACTGTGACTTCCGTGTCCCGGGACTCCCCCATCGGGAACCTGGGGAAGGAGCT
335 G P D L Q S R L K E Q L E W Q L G P A R
1141 GGGCCCAGACTTGCAGTCCAGACTGAAAGAGCAGCTGGAGTGGCAGCTCGGGCCGGCCCG
355 G D E R E S L R L R A A R E L H R R A D
1201 AGGGGACGAGCGGGAGAGCCTGCGCCTCCGAGCCGCGCGGGAGCTGCACCGCCGCGCAGA
375 G D T G S H G L G G Q T C F S L E M E E
1261 CGGGGACACCGGGAGCCACGGGCTGGGAGGCCAGACCTGCTTCAGCCTGGAGATGGAGGA
395 E H L Y A L R W K E L E M H S L A L Q N
1321 GGAGCACCTCTATGCCTTGAGGTGGAAAGAACTGGAAATGCACAGCCTGGCTTTGCAAAA
415 T L H E R T W S D E K N L M Q Q E L R S
1381 CACCCTCCATGAGCGAACCTGGAGTGATGAGAAGAATCTGATGCAGCAGGAGCTCCGGTC
435 L K Q N I F L F Y V K L R W L L K H W R
1441 CTTGAAGCAGAACATTTTCCTCTTCTACGTCAAACTCAGGTGGCTGCTGAAACACTGGCG
455 Q G K Q M E E E G E E F T E G E H P E T
1501 GCAAGGGAAGCAGATGGAGGAGGAAGGAGAGGAGTTCACTGAGGGTGAACATCCAGAGAC
475 L S R L G E L G V Q G G H Q A D G P D H
1561 CCTCTCCAGGCTCGGGGAGCTTGGAGTCCAGGGGGGTCACCAGGCGGATGGCCCAGACCA
495 D S D R G C G F P V G E H S P H S R V Q
1621 CGACAGTGACCGAGGCTGTGGCTTTCCAGTGGGGGAGCACTCCCCACACTCCCGGGTGCA
515 I G D H S L R L Q T A D R G Q P H K Q V
1681 GATTGGAGATCACAGCTTGCGGCTGCAGACCGCGGACAGGGGACAGCCCCACAAACAGGT
535 V E N Q Q L F S A F K A L L E D F R A E
1741 GGTGGAAAACCAGCAGCTGTTCAGCGCCTTCAAGGCCTTGCTGGAGGACTTCCGTGCGGA
555 L R E D E R A R L R L Q Q Q Y A S D K A
1801 GCTGCGGGAGGATGAGCGTGCCCGACTACGGCTGCAGCAGCAATATGCCAGCGACAAGGC
575 A W D V E W A V L K C R L E Q N C C G Y
1861 GGCCTGGGACGTGGAGTGGGCCGTGCTCAAGTGCCGTCTGGAACAGAATTGTTGTGGATA
595 P R I N I E E E T L G F T R L P A G S T
1921 TCCCAGAATTAACATTGAGGAGGAGACTTTAGGCTTCACCAGGCTGCCAGCTGGGTCCAC
615 V K T L K S L G L Q R L E L E E K T E N
1981 GGTAAAAACGTTGAAGAGCCTTGGGTTGCAGAGATTGGAGCTGGAAGAGAAGACTGAGAA
635 K L G E L G S S A E S K G A L K K E R E
2041 CAAGTTGGGAGAACTAGGCTCCTCCGCTGAGAGCAAGGGGGCCTTGAAGAAGGAGAGAGA
655 V H Q K L L A D S H S L V M D L R W Q I
2101 GGTGCACCAGAAGCTCCTGGCAGACAGTCACAGCCTGGTCATGGACCTGCGCTGGCAGAT
675 H H S E K N W N R E K V E L L D R L D R
2161 CCATCACAGCGAGAAGAACTGGAACCGGGAGAAGGTGGAACTTCTCGACCGCCTGGACAG
695 D R Q E W E R Q K K E F L W R I E Q G S
2221 AGATCGGCAGGAGTGGGAGCGGCAGAAGAAGGAATTCTTGTGGAGGATAGAGCAGGGAAG
715 L R M P R P V A M W P C A D A D S I P F
2281 CCTCCGCATGCCCCGTCCAGTGGCCATGTGGCCTTGTGCAGATGCTGACTCCATCCCGTT
735 E D R P L S K L K E S D R C S A S E N L
2341 TGAAGACCGGCCGCTGTCCAAGCTGAAGGAGTCGGACAGGTGCTCGGCCAGTGAGAATCT
755 Y L D A L S L D D E P E E P P A H R P E
2401 CTACCTGGATGCCTTGTCCCTGGATGACGAGCCAGAAGAGCCACCAGCCCACAGGCCCGA
775 R E F R N R L P E E E E N H K G N L Q R
2461 GAGGGAGTTCAGGAACCGCCTCCCTGAGGAAGAAGAAAATCACAAAGGAAATCTTCAAAG
795 A V S V S S M S E F Q R L M D I S P F L
2521 GGCGGTGTCCGTGTCCTCCATGTCTGAGTTCCAGCGTCTAATGGACATCTCCCCCTTCCT
815 P E K G L P S T S S K E D V T P P L S P
2581 GCCTGAGAAGGGCCTGCCGTCCACCAGCAGCAAGGAGGATGTCACCCCACCCCTGTCTCC
835 D D L K Y I E E F N K S W D Y T P N R G
2641 AGACGACCTCAAGTACATCGAGGAGTTCAACAAGAGCTGGGACTACACACCCAACAGGGG
855 H N G G G P D L W A D R T E V G R A G H

Figure 2N.3 (continued)

```
2701 CCACAATGGTGGGGGGCCGGACCTTTGGGCCGACAGGACCGAGGTGGGGCGGGCAGGGCA
 875  E  D  S  T  E  P  F  P  D  S  S  W  Y  L  T  T  S  V  T  M
2761 CGAGGACAGCACAGAGCCTTTCCCCGACTCCTCCTGGTACCTAACCACAAGTGTCACCAT
 895  T  T  D  T  M  T  S  P  E  H  C  Q  K  Q  P  L  R  S  H  V
2821 GACCACGGACACCATGACCAGCCCAGAGCACTGCCAGAAGCAGCCACTGCGGAGCCACGT
 915  L  T  E  Q  S  G  L  R  V  L  H  S  P  P  A  V  R  R  V  D
2881 CCTCACCGAGCAGTCGGGGTTGCGCGTGTTACACAGCCCGCCTGCCGTGCGCAGGGTCGA
 935  S  I  T  A  A  G  G  E  G  P  F  P  T  S  R  A  R  G  S  P
2941 CAGCATCACGGCGGCAGGTGGTGAGGGTCCCTTTCCCACAAGCAGAGCCAGAGGGAGCCC
 955  G  D  T  K  G  G  P  P  E  P  M  L  S  R  W  P  C  T  S  P
3001 GGGAGACACCAAGGGGGGCCCTCCAGAACCCATGCTCAGCAGGTGGCCTTGCACCTCCCC
 975  R  H  S  R  D  Y  V  E  G  A  R  R  P  L  D  S  P  L  C  T
3061 CAGGCACTCCCGGGACTATGTGGAGGGGGCACGGCGCCCCCTTGATAGTCCCCTCTGTAC
 995  S  L  G  F  A  S  P  L  H  S  L  E  M  S  K  N  L  S  D  D
3121 CTCCCTGGGGTTTGCCTCCCCACTGCACAGCCTGGAGATGTCCAAGAACTTGAGTGATGA
1015  M  K  E  V  A  F  S  V  R  N  A  I  C  S  G  P  G  E  L  Q
3181 CATGAAGGAGGTGGCCTTCTCTGTCAGGAATGCCATCTGCTCCGGCCCTGGCGAGCTGCA
1035  V  K  D  M  A  C  Q  T  N  G  S  R  T  M  G  T  Q  T  V  Q
3241 AGTCAAGGACATGGCCTGCCAGACCAATGGGTCCCGGACGATGGGGACCCAGACTGTTCA
1055  T  I  S  V  G  L  Q  T  E  A  L  R  G  S  G  V  T  S  S  P
3301 GACCATCAGTGTGGGCTTGCAGACTGAAGCCCTGCGTGGCAGCGGTGTCACCAGCAGCCC
1075  H  K  C  L  T  P  K  A  G  G  G  A  T  P  V  S  S  P  S  E
3361 CCACAAGTGTCTCACTCCAAAGGCTGGGGGCGGTGCTACACCCGTGTCGTCTCCTTCCCG
1095  S  L  R  S  R  Q  V  A  P  A  I  E  K  V  Q  A  K  F  E  R
3421 GAGCCTTAGGAGCAGACAGGTGGCCCCTGCCATCGAGAAGGTGCAGGCCAAGTTTGAACG
1115  T  C  C  S  P  K  Y  G  S  P  K  L  Q  R  K  P  L  P  K  A
3481 CACATGCTGCTCCCCCAAGTATGGTTCTCCCAAGCTGCAGAGGAAGCCCCTCCCCAAAGC
1135  D  Q  P  N  N  R  T  S  P  G  M  A  Q  K  G  Y  S  E  S  A
3541 CGACCAGCCAAATAACAGGACGTCACCAGGGATGGCCCAGAAAGGGTACAGTGAGTCAGC
1155  W  A  R  S  T  T  T  R  E  S  P  V  H  T  T  I  N  D  G  L
3601 CTGGGCCCGCTCCACCACCACAAGGGAGAGCCCCGTGCACACCACCATTAATGATGGCCT
1175  S  S  L  F  N  I  I  D  H  S  P  V  V  Q  D  P  F  Q  K  G
3661 CTCCAGCCTCTTCAACATCATTGACCACAGCCCCGTGGTGCAGGACCCCTTCCAGAAGGG
1195  L  R  A  G  S  R  S  R  S  A  E  P  R  P  E  L  G  P  G  Q
3721 GCTGCGGGCCGGCAGTCGGTCTCGCTCAGCAGAGCCCCGACCAGAGCTGGGCCCAGGCCA
1215  E  T  G  T  N  S  R  G  R  S  P  S  P  I  G  V  G  S  E  M
3781 GGAAACAGGCACCAATTCCCGAGGAAGGTCGCCTAGCCCCATTGGGGTGGGGTCAGAGAT
1235  C  R  E  E  G  G  E  G  T  P  V  K  Q  D  L  S  A  P  P  G
3841 GTGCAGGGAGGAAGGGGGAGAGGGCACGCCAGTGAAGCAGGACTTATCTGCTCCCCCTGG
1255  Y  T  L  T  E  N  V  A  R  I  L  N  K  K  L  L  E  H  A  L
3901 CTACACCCTCACTGAGAACGTGGCCCGGATCCTCAACAAGAAGCTGCTGGAACATGCCTT
1275  K  E  E  R  R  Q  A  A  H  G  P  P  G  L  H  S  D  S  H  S
3961 AAAGGAGGAGAGGAGGCAGGCTGCCCACGGGCCCCCGGGTCTCCACAGTGACAGCCACTC
1295  L  G  D  T  A  E  P  G  P  M  E  E  L  P  C  S  A  L  A
4021 GCTGGGGGACACAGCCGAGCCAGGGCCCATGGAGGAACTACCTTGTTCTGCACTAGCTCC
```

Figure 2O The cDNA (SEQ ID NO:53) and amino acid sequence (SEQ ID NO:54) of 185P3C2. The open reading frame extends from nucleic acid 3-1658 including the stop codon.

```
  1   N  C  L  L  R  P  K  N  K  S  V  R  W  G  P  G  A  G  A  A
  1 acAACTGTCTGCTGCGCCCGAAAAACAAGTCGGTGCGCTGGGGACCCGGGGCCGGGGCCG
 21   L  L  R  P  S  P  A  A  L  G  A  G  S  R  A  C  S  V  P  P
 61 CCTTACTCCGGCCTAGCCCCGCGGCCCTCGGTGCGGGCTCCAGGGCATGCTCGGTACCCC
 41   A  A  P  A  Q  T  P  R  P  Q  V  S  A  P  A  W  G  P  G  R
121 CCGCGGCTCCAGCCCAGACGCCCCGGCCTCAGGTCTCGGCCCCCGCTTGGGGCCCCGGCC
 61   A  A  R  G  S  G  R  M  E  R  R  M  K  A  G  Y  L  D  Q  Q
181 GTGCGGCGCGAGGGAGCGGCCGGATGGAGCGGAGGATGAAAGCCGGATACTTGGACCAGC
 81   V  P  Y  T  F  S  S  K  S  P  G  N  G  S  L  R  E  A  L  I
241 AAGTGCCCTACACCTTCAGCAGCAAATCGCCCGGAAATGGGAGCTTGCGCGAAGCGCTGA
101   G  P  L  G  K  L  M  D  P  G  S  L  P  P  L  D  S  E  D  L
301 TCGGCCCGCTGGGGAAGCTCATGGACCCGGGCTCCCTGCCGCCCCTCGACTCTGAAGATC
121   F  Q  D  L  S  H  F  Q  E  T  W  L  A  E  A  Q  V  P  D  S
361 TCTTCCAGGATCTAAGTCACTTCCAGGAGACGTGGCTCGCTGAAGCTCAGGTACCAGACA
141   D  E  Q  F  V  P  D  F  H  S  E  N  L  A  F  H  S  P  T  T
421 GTGATGAGCAGTTTGTTCCTGATTTCCATTCAGAAAACCTAGCTTTCCACAGCCCCACCA
161   R  I  K  K  E  P  Q  S  P  R  T  D  P  A  L  S  C  S  R  K
481 CCAGGATCAAGAAGGAGCCCCAGAGTCCCCGCACAGACCCGGCCCTGTCCTGCAGCAGGA
181   P  P  L  P  Y  H  H  G  E  Q  C  L  Y  S  S  A  Y  D  P  P
541 AGCCGCCACTCCCCTACCACCATGGCGAGCAGTGCCTTTACTCCAGTGCCTATGACCCCC
```

Figure 2O (continued)

```
 201  R  Q  I  A  I  K  S  P  A  P  G  A  L  G  Q  S  P  L  Q  P
 601 CCAGACAAATCGCCATCAAGTCCCCTGCCCCTGGTGCCCTTGGACAGTCGCCCCTACAGC
 221  F  P  R  A  E  Q  R  N  F  L  R  S  S  G  T  S  Q  P  H  P
 661 CCTTTCCCCGGGCAGAGCAACGGAATTTCCTGAGATCCTCTGGCACCTCCCAGCCCCACC
 241  G  H  G  Y  L  G  E  H  S  S  V  F  Q  Q  P  L  D  I  C  H
 721 CTGGCCATGGGTACCTCGGGGAACATAGCTCCGTCTTCCAGCAGCCCCTGGACATTTGCC
 261  S  F  T  S  Q  G  G  G  R  E  P  L  P  A  P  Y  Q  H  Q  L
 781 ACTCCTTCACATCTCAGGGAGGGGGCCGGGAACCCCTCCCAGCCCCCTACCAACACCAGC
 281  S  E  P  C  P  P  Y  P  Q  Q  S  F  K  Q  E  Y  H  D  P  L
 841 TGTCGGAGCCCTGCCCACCCTATCCCCAGCAGAGCTTTAAGCAAGAATACCATGATCCCC
 301  Y  E  Q  A  G  Q  P  A  V  D  Q  G  G  V  N  G  H  R  Y  P
 901 TGTATGAACAGGCGGGCCAGCCAGCCGTGGACCAGGGTGGGGTCAATGGGCACAGGTACC
 321  G  A  G  V  V  I  K  Q  E  Q  T  D  F  A  Y  D  S  D  V  T
 961 CAGGGGCGGGGGTGGTGATCAAACAGGAACAGACGGACTTCGCCTACGACTCAGATGTCA
 341  G  C  A  S  M  Y  L  H  T  E  G  F  S  G  P  S  P  G  D  G
1021 CCGGGTGCGCATCAATGTACCTCCACACAGAGGGCTTCTCTGGGCCCTCTCCAGGTGACG
 361  A  M  G  Y  G  Y  E  K  P  L  R  P  F  P  D  D  V  C  V  V
1081 GGGCCATGGGCTATGGCTATGAGAAACCTCTGCGACCATTCCCAGATGATGTCTGCGTTG
 381  P  E  K  F  E  G  D  I  K  Q  E  G  V  G  A  F  R  E  G  P
1141 TCCCTGAGAAATTTGAAGGAGACATCAAGCAGGAAGGGGTCGGTGCATTTCGAGAGGGGC
 401  P  Y  Q  R  R  G  A  L  Q  L  W  Q  F  L  V  A  L  L  D  D
1201 CGCCCTACCAGCGCCGGGGTGCCCTGCAGCTGTGGCAATTTCTGGTGGCCTTGCTGGATG
 421  P  T  N  A  H  F  I  A  W  T  G  R  G  M  E  F  K  L  I  E
1261 ACCCAACAAATGCCCATTTCATTGCCTGGACGGGCCGGGGAATGGAGTTCAAGCTCATTG
 441  P  E  E  V  A  R  L  W  G  I  Q  K  N  R  P  A  M  N  Y  D
1321 AGCCTGAGGAGGTCGCCAGGCTCTGGGGCATCCAGAAGAACCGGCCAGCCATGAATTACG
 461  K  L  S  R  S  L  R  Y  Y  Y  E  K  G  I  M  Q  K  V  A  G
1381 ACAAGCTGAGCCGCTCGCTCCGATACTATTATGAGAAAGGCATCATGCAGAAGGTGGCTG
 481  E  R  Y  V  Y  K  F  V  C  E  P  E  A  L  F  S  L  A  F  P
1441 GTGAGCGTTACGTGTACAAGTTTGTGTGTGAGCCCGAGGCCCTCTTCTCTTTGGCCTTCC
 501  D  N  Q  R  P  A  L  K  A  E  F  D  R  P  V  S  E  E  D  T
1501 CGGACAATCAGCGTCCAGCTCTCAAGGCTGAGTTTGACCGGCCTGTCAGTGAGGAGGACA
 521  V  P  L  S  H  L  D  E  S  P  A  Y  L  P  E  L  A  G  P  A
1561 CAGTCCCTTTGTCCCACTTGGATGAGAGCCCCGCCTACCTCCCAGAGCTGGCTGGCCCCG
 541  Q  P  F  G  P  K  G  G  Y  S  Y  *
1621 CCCAGCCATTTGGCCCCAAGGGTGGCTACTCTTACTAGcccccagcggctgttcccccctg
1681 ccgcaggtgggtgctgccctgtgtacatataaatgaatctggtgttggggaaaccttcat
1741 ctgaaacccacagatgtctctggggcagatccccactgtcctaccagttgccctagccca
1801 gactctgagctgctcaccggagtcattgggaaggaaaagtggagaaatggcaagtctaga
1861 gtctcagaaactcccctgggggtttcacctgggccctggaggaattcagctcagcttctt
1921 cctaggtccaagcccccacaccttttccccaaccacagagaacaagagtttgttctgtt
1981 ctgggggacagagaaggcgcttcccaacttcatactggcaggagggtgaggaggttcact
2041 gagctccccagatctcccactgcggggagacagaagcctggactctgccccacgctgtgg
2101 ccctggagggtcccggtttgtcagttcttggtgctctgtgttcccagaggcaggcggagg
2161 ttgaagaaaggaacctgggatgaggggtgctgggtataagcagagagggatgggttcctg
2221 ctccaagggaccctttgcctttcttctgccctttcctaggcccaggcctgggtttgtact
2281 tccacctccaccacatctgccagaccttaataaaggcccccacttctcccatt
```

Figure 2P The cDNA (SEQ ID NO:55) and amino acid sequence (SEQ ID NO:56) of 186P1H9. The start methionine is underlined. The open reading frame extends from nucleic acid 170-1462 including the stop codon.

```
   1 gagcagcgcggtgggtgcggctgtgagacggcaggagacttctgccccgcggtgcacgcg
  61 accctcgagacgacagcgcggctactgccagcagcgaaggcgcctcccgcggagcgcccc
   1                                                  M  L  A  L
 121 gacggcgcccgctcgcccatgccgagctgagcgcggcagcggcggcgggATGCTGGCGCT
   5  L  A  A  S  V  A  L  A  V  A  A  G  A  Q  D  S  P  A  P  G
 181 GCTGGCCGCCAGCGTGGCGCTCGCCGTGGCCGCTGGGGCCCAGGACAGCCCGGCGCCCGG
  25  S  R  F  V  C  T  A  L  P  P  E  A  V  H  A  G  C  P  L  P
 241 TAGCCGCTTCGTGTGCACGGCACTGCCCCCAGAGGCGGTGCACGCCGGCTGCCCGCTGCC
  45  A  M  P  M  Q  G  G  A  Q  S  P  E  E  E  L  R  A  A  V  L
 301 CGCGATGCCCATGCAGGGCGGCGCGCAGAGTCCCGAGGAGGAGCTGAGGGCCGCGGTGCT
  65  Q  L  R  E  T  V  V  Q  Q  K  E  T  L  A  S  A  R  A  I  R
 361 GCAGCTGCGCGAGACCGTCGTGCAGCAGAAGGAGACGCTGGCCAGCGCGAGGGCCATCCG
  85  E  L  T  G  K  L  A  R  C  E  G  L  A  G  G  K  A  R  G  A
 421 CGAGCTCACGGGCAAGCTAGCGCGCTGCGAGGGGCTGGCGGGCGGCAAGGCGCGCGGCGC
 105  G  A  T  G  K  D  T  M  G  D  L  P  R  D  P  G  H  V  V  E
 481 GGGGGCCACGGGCAAGGACACTATGGGCGACCTGCCGCGGGACCCCGGCCACGTCGTGGA
 125  Q  L  S  R  S  L  Q  T  L  K  D  R  L  E  S  L  E  H  Q  L
 541 GCAGCTCAGCCGCTCGCTGCAGACCCTCAAGGACCGCCTGGAGAGCCTCGAGCACCAGCT
 145  R  A  N  V  S  N  A  G  L  P  G  D  F  R  E  V  L  Q  Q  R
```

Figure 2P (continued)

```
 601 CAGAGCAAACGTGTCCAATGCTGGGCTGCCCGGCGACTTCCGCGAGGTGCTCCAGCAGCG
 165  L  G  E  L  E  R  Q  L  L  R  K  V  A  E  L  E  D  E  K  S
 661 GCTGGGGGAGCTGGAGAGGCAGCTTCTGCGCAAGGTGGCAGAGCTGGAGGACGAGAAGTC
 185  L  L  H  N  E  T  S  A  H  R  Q  K  T  E  S  T  L  N  A  L
 721 CCTGCTGCACAATGAGACCTCGGCTCACCGGCAGAAGACCGAGAGCACCCTGAACGCGCT
 205  L  Q  R  V  T  E  L  E  R  G  N  S  A  F  K  S  P  D  A  F
 781 GCTGCAGAGGGTCACCGAGCTGGAGCGAGGCAATAGCGCCTTTAAGTCACCAGATGCGTT
 225  K  V  S  L  P  L  R  T  N  Y  L  Y  G  K  I  K  K  T  L  P
 841 CAAGGTGTCCCTCCCACTCCGCACAAACTACCTATACGGCAAGATCAAGAAGACGCTGCC
 245  E  L  Y  A  F  T  I  C  L  W  L  R  S  S  A  S  P  G  I  G
 901 TGAGCTGTACGCCTTCACCATCTGCCTGTGGCTGCGGTCCAGCGCCTCACCAGGCATTGG
 265  T  P  F  S  Y  A  V  P  G  Q  A  N  E  I  L  L  I  E  W  G
 961 CACCCCCTTCTCCTATGCGGTGCCAGGGCAGGCCAACGAGATCTTGCTGATCGAGTGGGG
 285  N  N  P  I  E  L  L  I  N  D  K  V  A  Q  L  P  L  F  V  S
1021 CAACAACCCCATCGAGCTGCTCATCAACGACAAGGTTGCGCAGCTGCCCCTGTTTGTCAG
 305  D  G  K  W  H  H  I  C  V  T  W  T  T  R  D  G  M  W  E  A
1081 TGACGGCAAGTGGCACCACATCTGTGTCACCTGGACGACACGGGATGGCATGTGGGAGGC
 325  F  Q  D  G  E  K  L  G  T  G  E  N  L  A  P  W  H  P  I  K
1141 ATTCCAGGACGGAGAGAAGCTGGGCACTGGGGAGAACCTGGCCCCCTGGCACCCCATCAA
 345  P  G  G  V  L  I  L  G  Q  E  Q  D  T  V  G  G  R  F  D  A
1201 GCCCGGGGGCGTGCTGATCCTTGGACAAGAGCAGGACACCGTGGGGGGTAGGTTTGATGC
 365  T  Q  A  F  V  G  E  L  S  Q  F  N  I  W  D  R  V  L  R  A
1261 CACTCAGGCATTTGTCGGGGAGCTCAGCCAGTTCAACATATGGGACCGCGTCCTTCGCGC
 385  Q  E  I  V  N  I  A  N  C  S  T  N  M  P  G  N  I  I  P  W
1321 ACAAGAAATTGTCAACATCGCCAACTGCTCCACAAACATGCCGGGCAACATCATCCCGTG
 405  V  D  N  N  V  D  V  F  G  G  A  S  K  W  P  V  E  T  C  E
1381 GGTGGACAATAACGTCGATGTGTTCGGAGGGGCCTCCAAGTGGCCCGTGGAGACGTGTGA
 425  E  A  L  L  D  L  *
1441 GGAGGCTCTCCTTGACTTGTAGccgccttctcctctgtccaggaggccgggatcaggctg
1501 ttgccatggaagttcagggccatagactgccccacttaaactcttgtcagtctgggctca
1561 gggttcccagagctcattccccaggaatctctaagaccagggctggggcagtgtctgtca
1621 ctggcttgtttgttccctaccaatattctgttgctgtttgaagtagtgccagggtcccct
1681 gggaagatgcccccaagacacctgccccaagtgggtggatatctgccttcctgctgcaag
1741 tggaggcaggtccagcagcccctcttcagagcccctgtaaatgctatcgcagcctgagtc
1801 ctgccgccttccagttccttggtgtcccgtgcacccctctgtctgtcccctttcatgct
1861 gtgcagccgtcccgctggagtggccatgtcccttgtgcattgagtgcatccccgctggtg
1921 actaagctcgcagcaagcgctacccccgatctgcaaaagggcctctccctttgtgttcta
1981 tacattgtgaatcttcccgtctgaagaacgcccagcctgcccagacaaagccccgccttc
2041 cccaaagcagaggggctgtctgtgtctccagaaaggggacatcggggggggagggggct
2101 cagaaaggagaagggctgtgatctccggtcccttcccccatcatccttccttagactgat
2161 gctttgactgaatcatcactagctatggcattaaaggcctctcttctcatctggtgcca
2221 aaggttccgttgcagcttttacaaccatccggtgtggtttggaggatttgttttttttt
2281 tttcccaacagaaaagaacagccattagaagaaggctcccatttctgatgttccgcccc
2341 actgtgaagagtgtgctcgttttaaattcatgttgattcttgtaagcactggactgtctt
2401 catcaagtatttcccctacagaactcctcaagaaaaacagagatcatttggctagagatt
2461 gtctgagtgactccaagctactcactgtattggacgggagtagtaatttattttaaagat
2521 aaagtgactaagtggggaaatttataaagctaaatattatatattttatttttcatacat
2581 gtttgaagtgcaaatctgtggatattccatttgtaggaccaagtcgacatgcccatcctg
2641 acattgtatgctacgagaactcttctgatgatggaatttcgattaaagtgcactgaaaga
2701 tg
```

Figure 2Q The cDNA (SEQ ID NO:57) and amino acid sequence (SEQ ID NO:58) of 187P3F2. The start methionine is underlined. The open reading frame extends from nucleic acid 60-1562 including the stop codon.

```
   1                                                           M
   1 ctgctgctgcggcggcggcggcggtggtggcggcggtggggtggcgggagcggagcggcA
   2  A  T  A  A  S  N  P  Y  L  P  G  N  S  L  L  A  A  G  S  I
  61 TGGCCACGGCGGCTTCTAACCCCTACCTGCCGGGGAACAGCCTGCTCGCGGCCGGCTCTA
  22  V  H  S  D  A  A  G  A  G  G  G  G  G  G  G  G  G  S  G  G
 121 TTGTGCACTCGGACGCGGCGGGGGCTGGCGGCGGCGGGGGTGGCGGCGGCGGCAGCGGCG
  42  G  G  A  G  G  G  G  G  G  M  Q  P  G  S  A  A  V  T  S  G
 181 GGGGCGGCGCAGGGGGCGGGGGCGGCGGCATGCAGCCGGGCAGCGCCGCCGTGACCTCGG
  62  A  Y  R  G  D  P  S  S  V  K  M  V  Q  S  D  F  M  Q  G  A
 241 GCGCCTACCGGGGGGACCCGTCCTCTGTCAAGATGGTCCAGAGCGACTTCATGCAGGGGG
  82  M  A  A  S  N  G  G  H  M  L  S  H  A  H  Q  W  V  T  A  L
 301 CCATGGCCGCCAGCAACGGCGGCCATATGCTGAGCCACGCGCACCAGTGGGTCACAGCCC
 102  P  H  A  A  A  A  A  A  A  A  A  A  A  A  V  E  A  S  S  P
 361 TGCCCCACGCCGCCGCCGCCGCCGCCGCTGCCGCCGCCGCCGCCGTGGAGGCGAGCTCGC
 122  W  S  G  S  A  V  G  M  A  G  S  P  Q  Q  P  P  Q  P  P  P
 421 CGTGGTCGGGCAGCGCCGTGGGCATGGCTGGCAGCCCCCAGCAGCCACCGCAGCCGCCGC
```

Figure 2Q (continued)

```
 142  P  P  P  Q  G  P  D  V  K  G  G  A  G  R  D  D  L  H  A  G
 481 CGCCACCGCCGCAGGGCCCCGACGTGAAGGGCGGCGCCGGGCGCGACGACCTGCACGCGG
 162  T  A  L  H  H  R  G  P  P  H  L  G  P  P  P  P  P  P  H  Q
 541 GCACAGCGCTGCACCACCGCGGGCCGCCGCACCTCGGACCCCCGCCGCCGCCCCCACACC
 182  G  H  P  G  G  W  G  A  A  A  A  A  A  A  A  A  A  A  A  A
 601 AGGGCCACCCTGGGGGCTGGGGGGCGGCCGCCGCTGCCGCAGCCGCAGCCGCCGCCGCCG
 202  A  A  A  H  L  P  S  M  A  G  G  Q  Q  P  P  P  Q  S  L  L
 661 CCGCCGCCGCGCACCTCCCGTCCATGGCCGGGGGCCAGCAGCCGCCGCCGCAGAGTCTGC
 222  Y  S  Q  P  G  G  F  T  V  N  G  M  L  S  A  P  P  G  P  G
 721 TCTACTCGCAGCCCGGAGGCTTCACGGTGAACGGCATGCTGAGCGCGCCACCGGGGCCCG
 242  G  G  G  G  G  A  G  G  G  A  Q  S  L  V  H  P  G  L  V  R
 781 GCGGCGGCGGCGGCGGCGCGGGCGGTGGAGCCCAGAGCTTGGTGCACCCGGGGCTGGTGC
 262  G  D  T  P  E  L  A  E  H  H  H  H  H  H  H  H  A  H  P  H
 841 GCGGGGACACGCCAGAGCTGGCCGAGCACCACCACCACCACCACCACGCGCATCCTC
 282  P  P  H  P  H  H  A  Q  G  P  P  H  H  G  G  G  G  G  G  A
 901 ACCCGCCGCACCCGCACCACGCGCAGGGACCCCCGCACCACGGCGGCGGCGGCGGCGGCG
 302  G  P  G  L  N  S  H  D  P  H  S  D  E  D  T  P  T  S  D  D
 961 CGGGGCCTGGACTCAACAGCCACGACCCGCACTCGGACGAGGACACGCCGACGTCGGACG
 322  L  E  Q  F  A  K  Q  F  K  Q  R  R  I  K  L  G  F  T  Q  A
1021 ACCTGGAGCAGTTCGCCAAGCAGTTCAAGCAGCGGCGCATCAAGCTGGGCTTCACGCAGG
 342  D  V  G  L  A  L  G  T  L  Y  G  N  V  F  S  Q  T  T  I  C
1081 CCGACGTGGGGTTGGCGCTGGGCACACTCTACGGCAACGTGTTCTCGCAGACCACCATCT
 362  R  F  E  A  L  Q  L  S  F  K  N  M  C  K  L  K  P  L  L  N
1141 GCCGCTTCGAGGCCCTGCAGCTGAGCTTCAAGAACATGTGCAAGCTCAAGCCGCTGCTGA
 382  K  W  L  E  E  A  D  S  S  T  G  S  P  T  S  I  D  K  I  A
1201 ACAAGTGGCTGGAGGAGGCGGACTCAAGCACCGGCAGCCCCACAAGCATCGACAAGATCG
 402  A  Q  G  R  K  R  K  K  R  T  S  I  E  V  S  V  K  G  A  L
1261 CGGCGCAGGGTCGCAAGCGCAAGAAGCGGACCTCTATCGAGGTGAGCGTCAAGGGCGCGC
 422  E  S  H  F  L  K  C  P  K  P  S  A  Q  E  I  T  N  L  A  D
1321 TGGAGAGCCACTTCCTCAAGTGCCCCAAGCCCTCCGCGCAGGAGATCACCAACCTGGCCG
 442  S  L  Q  L  E  K  E  V  V  R  V  W  F  C  N  R  R  Q  K  E
1381 ACAGCCTGCAGCTCGAGAAGGAGGTGGTGCGGGTCTGGTTCTGCAATCGGCGCCAAAAGG
 462  K  R  M  T  P  P  G  I  Q  Q  Q  T  P  D  D  V  Y  S  Q  V
1441 AGAAGCGCATGACGCCGCCCGGGATCCAACAGCAGACGCCCGACGACGTCTACTCGCAGG
 482  G  T  V  S  A  D  T  P  P  P  H  H  G  L  Q  T  S  V  Q  *
1501 TGGGCACCGTGAGCGCCGACACGCCGCCGCCTCACCACGGGCTGCAGACGAGCGTTCAGT
1561 GAagccagggcgcagagcgaagagtgccgccgccgccgccgcctccgcagccgccgtcag
1621 caccgccgccgcccctgccgccgccgccgccgccgccgccgctgccgccgccgcgc
```

Figure 2R The cDNA (SEQ ID NO:59) and amino acid sequence (SEQ ID NO:60) of 192P2G7. The start methionine is underlined. The open reading frame extends from nucleic acid 84-938 including the stop codon.

```
   1 ccacgcgtccggcgcgggcgcgggcgcgggcgcgtgcgggctgcgagccgggaggcggcg
   1                          M  A  E  S  E  A  E  T  P  S  T  P  G
  61 gcggcgacggcgacggcggcggcATGGCGGAGAGCGAGGCCGAGACCCCCAGCACCCCGG
  14  E  F  E  S  K  Y  F  E  F  H  G  V  R  L  P  P  F  C  R  G
 121 GGGAGTTCGAGAGCAAGTACTTCGAGTTCCATGGCGTGCGGCTGCCGCCCTTCTGCCGCG
  34  K  M  E  E  I  A  N  F  P  V  R  P  S  D  V  W  I  V  T  Y
 181 GGAAGATGGAGGAGATCGCCAACTTCCCGGTGCGGCCCAGCGACGTGTGGATCGTCACCT
  54  P  K  S  G  T  S  L  L  Q  E  V  V  Y  L  V  S  Q  G  A  D
 241 ACCCCAAGTCCGGCACCAGCTTGCTGCAGGAGGTGGTCTACTTGGTGAGCCAGGGCGCTG
  74  P  D  E  I  G  L  M  N  I  D  E  Q  L  P  V  L  E  Y  P  Q
 301 ACCCCGATGAGATCGGCTTGATGAACATCGACGAGCAGCTCCCGGTCCTGGAGTACCCAC
  94  P  G  L  D  I  I  K  E  L  T  S  P  R  L  I  K  S  H  L  P
 361 AGCCGGGCCTGGACATCATCAAGGAACTGACCTCTCCCCGCCTCATCAAGAGCCACCTGC
 114  Y  R  F  L  P  S  D  L  H  N  G  D  S  K  V  I  Y  M  A  R
 421 CCTACCGCTTTCTGCCCTCTGACCTCCACAATGGAGACTCCAAGGTCATCTATATGGCTC
 134  N  P  K  D  L  V  V  S  Y  Y  Q  F  H  R  S  L  R  T  M  S
 481 GCAACCCCAAGGATCTGGTGGTGTCTTATTATCAGTTCCACCGCTCTCTGCGGACCATGA
 154  Y  R  G  T  F  Q  E  F  C  R  R  F  M  N  D  K  L  G  Y  G
 541 GCTACCGAGGCACCTTTCAAGAATTCTGCCGGAGGTTTATGAATGATAAGCTGGGCTACG
 174  S  W  F  E  H  V  Q  E  F  W  E  H  R  M  D  S  N  V  L  F
 601 GCTCCTGGTTTGAGCACGTGCAGGAGTTCTGGGAGCACCGCATGGACTCGAACGTGCTTT
 194  L  K  Y  E  D  M  H  R  D  L  V  T  M  V  E  Q  L  A  R  F
 661 TTCTCAAGTATGAAGACATGCATCGGGACCTGGTGACGATGGTGGAGCAGCTGGCCAGAT
 214  L  G  V  S  C  D  K  A  Q  L  E  A  L  T  E  H  C  H  Q  L
 721 TCCTGGGGGTGTCCTGTGACAAGGCCCAGCTGGAAGCCCTGACGGAGCACTGCCACCAGC
 234  V  D  Q  C  C  N  A  E  A  L  P  V  G  R  G  R  V  G  L  W
 781 TGGTGGACCAGTGCTGCAACGCTGAGGCCCTGCCCGTGGGCCGGGGAAGAGTTGGGCTGT
 254  K  D  I  F  T  V  S  M  N  E  K  F  D  L  V  Y  K  Q  K  M
```

Figure 2R (continued)

```
 841 GGAAGGACATCTTCACCGTCTCCATGAATGAGAAGTTTGACTTGGTGTATAAACAGAAGA
 274   G  K  C  D  L  T  F  D  F  Y  L  *
 901 TGGGAAAGTGTGACCTCACGTTTGACTTTTATTTATAAtaacagaaacaacaacctgcat
 961 gctcacaatacccagacagtctactagccaaaagtcctgtatgcattcatttattccttg
1021 ctggacaaactctggaagcagcgtgtgaaacagcgggggaagggaagagcggcgtgagcg
1081 gagggagtgtgatgattcccaaccgaaagcagctgtctcgcctttagaacgtgcagcctc
1141 tccatgtctgattacaaacagtctccacattgcagttccaatggcctggaccgtaaggat
1201 aaagcctgtaatatatgcaactagaatgtctgccttttcaaccccgtattatttattgta
1261 ttttatagagcttttcactggaaatctacataaatgtcagtaaaccaaataaaagttcat
1321 ttccaaggggaatcaggagcgagccacacccgaatggtagaaagatctcagggttaactc
1381 tttatttttgtagttttattatctaaggcacagccattctgttctcacttggttctgaga
1441 tagtggtgagaacagaggatgagttgggtctgttgggggaatctggacacttgtttatt
1501 ctgacggagttcacttcttcagaaccttcctgaaatgagcagaaattgttcactaggtct
1561 tcagaatggacgtccttctgccagagacttccagcgggcggctccaaaggcccaatgcag
1621 aggagcccgcggagcatgtgctgagggaagtctgcctggtgaggctggcaggtgggagtc
1681 taatgcagtcaggagcatttgcatgcagtgggtggagagtcggccaccaaaggaccgagt
1741 tgcgctcggaatttgagctgaattccacagccttactttgtttcctgaagtgatagccta
1801 ctaatgctggcaagcagatgcttaatagtaaatttctaaaatccccgggtctttatcatt
1861 cagtttgttctgtgcacctgaggcgctcagccgtgggaggaccattttgcgagtgtagcc
1921 ctgtttcactcggatcaggttggcacggccgcctgcgtgtctgtccacctcatccctccg
1981 tgtatctgagggagtaaaggtgaggtctttattgcttcactgcctaattttctcacccac
2041 attcgctgaagcgatggagagtcgggggccagtagccagccaaccccgtggggaccgggg
2101 ttgtctgtcatttatgtggctggaaagcacccaaagtggtggtcaggagggtcgctgctg
2161 tggaaggggtctccgttcttggtgctgtatttgaaacgggtgtagagagaagcttgtgtt
2221 tttgtttgtaatggggagaagcgtggccaggcagtggcacgtggcatcgcatggtgggct
2281 cggcagcaccttgcctgtgtttctgtgagggaggctgctttctgtgaaatttctttatat
2341 ttttctatttttagtactgtatggatgttactgagcactacacatgatccttctgtgctt
2401 gcttgcatctttaataaagacatgttcccggcaaaaaaaaaaaaaaaaaaaaaaaaaaaa
2461 aaaaaaaaaaaaaaaaaaaaaaaaaaaaaaaa
```

Figure 3:

Figure 3A.1 74P3B3 v.1A amino acid sequence (SEQ ID NO:61) of 180 amino acids.

```
  1 MGQSKSKHSA YLHFIKLLLK RAGIKASTEN LITLFPTVEQ YCPWFPEHGT MDFKDWEQVG
 61 IALKQVCKEG KFIPLTAWSN WAIVKAASEP FQSENEAYPP AERISAEEGG DAAEGGEDSE
121 EDFEENTDKP GDELISFEEH VGPSAAPKIE KPYMPRCLKQ RRALRSSRLL IGIIRSGRLQ
```

Figure 3A.2 74P3B3 v.1B amino acid sequence (SEQ ID NO: 62) of 228 amino acids.

```
  1 MFKTKKGLEE QSAPHWDHPE WPFPIKQCSL EPWRSESQIC PVSRMNELWP QEPQAHGVAP
 61 VQHKAALPSN VNESPLQFII RQARLAGDLD AWQFAVVLQP PRQQGGAHQA VWEPFSFKLL
121 KDLKAAVGQY GPNSPFIRSL LQSVAQNKLL TPCDWEILTK VTLSPSQFLQ FKTWWTDEAQ
181 NQDRKNRAAN PAIAITFEQL LGIGGQWGTV NNHQDFEMMP LNKFAIAV
```

Figure 3B 83P4B8 amino acid sequence (SEQ ID NO:63) of 1328 amino acids.

```
   1 MDQKILSLAA EKTADKLQEF LQTLREGDLT NLLQNQAVKG KVAGALLRAI FKGSPCSEEA
  61 GTLRRRKIYT CCIQLVESGD LQKEIVSEII GLLMLEAHHF PGPLLVELAN EFISAVREGS
 121 LVNGKSLELL PIILTALATK KENLAYGKGV LSGEECKKQL INTLCSGRWD QQYVIQHTSM
 181 FKDVPLTAEE VEFVVEKALS MFSKMNLQEI PPLVYQLLVL SSKGSRKSVL EGIIAFFSAL
 241 DKQHNEEQSG DELLDVVTVP SGELRHVEGT IILHIVFAIK LDYELGRELV KHLKVGQQGD
 301 SNNNLSPFSI ALLLSVTRIQ RFQDQVLDLL KTSVVKSFKD LQLLQGSKFL QNLVPHRSYV
 361 STMILEVVKN SVHSWDHVTQ GLVELGFILM DSYGPKKVLD GKTIETSPSL SRMPNQHACK
 421 LGANILLETF KIHEMIRQEI LEQVLNRVVT RASSPISHFL DLLSNIVMYA PLVLQSCSSK
 481 VTEAFDYLSF LPLQTVQRLL KAVQPLLKVS MSMRDCLILV LRKAMFANQL DARKSAVAGF
 541 LLLLKNFKVL GSLSSSQCSQ SLSVSQVHVD VHSHYNSVAN ETFCLEIMDS LRRCLSQQAD
 601 VRLMLYEGFY DVLRRNSQLA NSVMQTLLSQ LKQFYEPKPD LLPPLKLDAC ILTQGDKISL
 661 QEPLDYLLCC IQHCLAWYKN TVIPLQQGEE EEEEEEAFYE DLDDILESIT NRMIKSELED
 721 FELDKSADFS QSTSIGIKNN ISAFLVMGVC EVLIEYNFSI SSFSKNRFED ILSLFMCYKK
 781 LSDILNEKAG KAKTKMANKT SDSLLSMKFV SSLLTALFRD SIQSHQESLS VLRSSNEFMR
 841 YAVNVALQKV QQLKETGHVS GPDGQNPEKI FQNLCDITRV LLWRYTSIPT SVEESGKKEK
 901 GKSISLLCLE GLQKIFSAVQ QFYQPKIQQF LRALDVTDKE GEEREDADVS VTQRTAFQIR
 961 QFQRSLLNLL SSQEEDFNSK EALLLVTVLT SLSKLLEPSS PQFVQMLSWT SKICKENSRE
1021 DALFCKSLMN LLFSLHVSYK SPVILLRDLS QDIHGHLGDI DQDVEVEKTN HFAIVNLRTA
1081 APTVCLLVLS QAEKVLEEVD WLITKLKGQV SQETLSEEAS SQATLPNQPV EKAIIMQLGT
1141 LLTFFHELVQ TALPSGSCVD TLLKDLCKMY TTLTALVRYY LQVCQSSGGI PKNMEKLVKL
1201 SGSHLTPLCY SFISYVQNKS KSLNYTGEKK EKPAAVATAM ARVLRETKPI PNLIFAIEQY
1261 EKFLIHLSKK SKVNLMQHMK LSTSRDFKIK GNILDMVLRE DGEDENEEGT ASEHGGQNKE
1321 PAKKKRKK
```

Figure 3C 109P1D4 amino acid sequence (SEQ ID NO:64) of 1021 amino acids.

```
   1 MDLLSGTYIF AVLLACVVFH SGAQEKNYTI REEMPENVLI GDLLKDLNLS LIPNKSLTTA
  61 MQFKLVYKTG DVPLIRIEED TGEIFTTGAR IDREKLCAGI PRDEHCFYEV EVAILPDEIF
 121 RLVKIRFLIE DINDNAPLFP ATVINISIPE NSAINSKYTL PAAVDPDVGI NGVQNYELIK
 181 SQNIFGLDVI ETPEGDKMPQ LIVQKELDRE EKDTYVMKVK VEDGGFPQRS STAILQVSVT
 241 DTNDNHPVFK ETEIEVSIPE NAPVGTSVTQ LHATDADIGE NAKIHFSFSN LVSNIARRLF
 301 HLNATTGLIT IKEPLDREET PNHKLLVLAS DGGLMPARAM VLVNVTDVND NVPSIDIRYI
 361 VNPVNDTVVL SENIPLNTKI ALITVTDKDA DHNGRVTCFT DHEIPFRLRP VFSNQFLLET
 421 AAYLDYESTK EYAIKLLAAD AGKPPLNQSA MLFIKVKDEN DNAPVFTQSF VTVSIPENNS
 481 PGIQLTKVSA MDADSGPNAK INYLLGPDAP PEFSLDCRTG MLTVVKKLDR EKEDKYLFTI
 541 LAKDNGVPPL TSNVTVFVSI IDQNDNSPVF THNEYNFYVP ENLPRHGTVG LITVTDPDYG
 601 DNSAVTLSIL DENDDFTIDS QTGVIRPNIS FDREKQESYT FYVKAEDGGR VSRSSSAKVT
 661 INVVDVNDNK PVFIVPPSNC SYELVLPSTN PGTVVFQVIA VDNDTGMNAE VCYSIVGGNT
 721 RDLFAIDQET GNITLMEKCD VTDLGLHRVL VKANDLGQPD SLFSVVIVNL FVNESVTNAT
 781 LINELVRKST EAPVTPNTEI ADVSSPTSDY VKILVAAVAG TITVVVVIFI TAVVRCRQAP
 841 HLKAAQKNKQ NSEWATPNPE NRQMIMMKKK KKKKKHSPKN LLLNFVTIEE TKADDVDSDG
 901 NRVTLDLPID LEEQTMGKYN WVTTPTTFKP DSPDLARHYK SASPQPAFQI QPETPLNSKH
 961 HIIQELPLDN TFVACDSISK CSSSSSDPYS VSDCGYPVTT FEVPVSVHTR PVGIQVSNTT
1021 F
```

Figure 3D 151P1C7A amino acid sequence (SEQ ID NO:65) of 266 amino acids.

```
  1 MMALGAAGAT RVFVAMVAAA LGGHPLLGVS ATLNSVLNSN AIKNLPPPLG GAAGHPGSAV
 61 SAAPGILYPG GNKYQTIDNY QPYPCAEDEE CGTDEYCASP TRGGDAGVQI CLACRKRRKR
121 CMRHAMCCPG NYCKNGICVS SDQNHFRGEI EETITESFGN DHSTLDGYSR RTTLSSKMYH
181 TKGQEGSVCL RSSDCASGLC CARHFWSKIC KPVLKEGQVC TKHRRKGSHG LEIFQRCYCG
241 EGLSCRIQKD HHQASNSSRL HTCQRH
```

Figure 3E 151P4E11 amino acid sequence (SEQ ID NO:66) of 123 amino acids.

```
  1 MARGSALLLA SLLLAAALSA SAGLWSPAKE KRGWTLNSAG YLLGPHAVGN HRSFSDKNGL
 61 TSKRELRPED DMKPGSFDRS IPENNIMRTI IEFLSFLHLK EAGALDRLLD LPAAASSEDI
121 ERS
```

Figure 3F 154P2A8 amino acid sequence (SEQ ID NO:67) of 358 amino acids.

```
  1 MGFNLTLAKL PNNELHGQES HNSGNRSDGP GKNTTLHNEF DTIVLPVLYL IIFVASILLN
 61 GLAVWIFFHI RNKTSFIFYL KNIVVADLIM TLTFPFRIVH DAGFGPWYFK FILCRYTSVL
121 FYANMYTSIV FLGLISIDRY LKVVKPFGDS RMYSITFTKV LSVCVWVIMA VLSLPNIILT
181 NGQPTEDNIH DCSKLKSPLG VKWHTAVTYV NSCLFVAVLV ILIGCYIAIS RYIHKSSRQF
241 ISQSSRKRKH NQSIRVVVAV FFTCFLPYHL CRIPFTFSHL DRLLDESAQK ILYYCKEITL
301 FLSACNVCLD PIIYFFMCRS FSRRLFKKSN IRTRSESIRS LQSVRRSEVR IYYDYTDV
```

Figure 3G 156P1D4 amino acid sequence (SEQ ID NO:68) of 222 amino acids.

```
  1 MLWLLFFLVT AIHAELCQPG AENAFKVRLS IRTALGDKAY AWDTNEEYLF KAMVAFSMRK
 61 VPNREATEIS HVLLCNVTQR VSFWFVVTDP SKNHTLPAVE VQSAIRMNKN RINNAFFLND
121 QTLEFLKIPS TLAPPMDPSV PIWIIIFGVI FCIIIVAIAL LILSGIWQRR RKNKEPSEVD
181 DAEDKCENMI TIENGIPSDP LDMKGGHIND AFMTEDERLT PL
```

Figure 3H 156P5C12 amino acid sequence (SEQ ID NO:69) of 227 amino acids.

```
  1 MAPCHIRKYQ ESDRQWVVGL LSRGMAEHAP ATFRQLLKLP RTLILLLGGP LALLLVSGSW
 61 LLALVFSISL FPALWFLAKK PWTEYVDMTL CTDMSDITKS YLSERGSCFW VAESEEKVVG
121 MVGALPVDDP TLREKRLQLF HLSVDSEHRR QGIAKALVRT VLQFARDQGY SEVILDTGTI
181 QLSAMALYQS MGFKKTGQSF FCVWARLVAL HTVHFIYHLP SSKVGSL
```

Figure 3I 159P2B5 amino acid sequence (SEQ ID NO:70) of 224 amino acids.

```
  1 MVKREHGQER PTFWGWAATP APVSAPGNPP TGEGERQGSP PGGGFLGSTS FQRRGEKELL
 61 WERGQDVSRS VLAMRAILPP SLSKSVHFPP LPHSCTLVAL LSLGLQDPLG CRAPATKPTP
121 AGATLSASSL PRPCSPSASL LLSWPLFWGI LGGVFFLGSR ACTRTQARRH TGPAAALLRL
181 LFPAPRRPGA RSRAGYASPG SPERRSPGTA HKGSLPWPLA LRLL
```

Figure 3J 161P2B7A amino acid sequence (SEQ ID NO:71) of 190 amino acids.

```
  1 MEDEGQTKIK QRRSRTNFTL EQLNELERLF DETHYPDAFM REELSQRLGL SEARVQVWFQ
 61 NRRAKCRKQE NQLHKGVLIG AASQFEACRV APYVNVGALR MPFQQVQAQL QLDSAVAHAH
121 HHLHPHLAAH APYMMFPAPP FGLPLATLAA DSASAASVVA AAAAAKTTSK NSSIADLRLK
181 AKKHAAALGL
```

Figure 3K 179P3G7 amino acid sequence (SEQ ID NO:72) of 342 amino acids.

```
  1 MTCPRNVTPN SYAEPLAAPG GGERYSRSAG MYMQSGSDFN CGVMRGCGLA PSLSKRDEGS
 61 SPSLALNTYP SYLSQLDSWG DPKAAYRLEQ PVGRPLSSCS YPPSVKEENV CCMYSAENRA
121 KSGPEAALYS HPLPESCLGE HEVPVPSYYR ASPSYSALDK TPHCSGANDF EAPFEQRASL
181 NPRAEHLESP QLGGKVSFPE TPKSDSQTPS PNEIKTEQSL AGPKGSPSES EKERAKAADS
241 SPDTSDNEAK EEIKAENTTG NWLTAKSGRK KRCPYTKHQT LELEKEFLFN MYLTRERRLE
301 ISKTINLTDR QVKIWFQNRR MKLKKMNREN RIRELTSNFN FT
```

Figure 3L 184P3C10B amino acid sequence (SEQ ID NO:73) of 372 amino acids.

```
  1 MKYLRHRRPN ATLILAIGAF TLLLFSLLVS PPTCKVQEQP PAIPEALAWP TPPTRPAPAP
 61 CHANTSMVTH PDFATQPQHV QNFLLYRHCR HFPLLQDVPP SKCAQPVFLL LVIKSSPSNY
121 VRRELLRRTW GRERKVRGLQ LRLLFLVGTA SNPHEARKVN RLLELEAQTH GDILQWDFHD
181 SFFNLTLKQV LFLQWQETRC ANASFVLNGD DDVFAHTDNM VFYLQDHDPG RHLFVGQLIQ
241 NVGPIRAFWS KYYVPEVVTQ NERYPPYCGG GGFLLSRFTA AALRRAAHVL DIFPIDDVFL
301 GMCLELEGLK PASHSGIRTS GVRAPSQHLS SFDPCFYRDL LLVHRFLPYE MLLMWDALNQ
361 PNLTCGNQTQ IY
```

Figure 3M 184P3G10 amino acid sequence (SEQ ID NO:74) of 748 amino acids.

```
  1 MNTAFAGKMV SVTKYDLTGC SAFCRSCQRA TMTSQPLRLA EEYGPSPGES ELAVNPFDGL
 61 PFSSRYYELL KQRQALPIWA ARFTFLEQLE SNPTGVVLVS GEPGSGKSTQ IPQWCAEFAL
121 ARGFQKGQVT VTQPYPLAAR SLALRVADEM DLTLGHEVGY SIPQEDCTGP NTLLRFCWDR
181 LLLQEVASTR GTGAWGVLVL DEAQERSVAS DSLQGLLQDA RLEKLPGDLR VVVVTDPALE
241 PKLRAFWGNP PIVHIPREPG ERPSPIYWDT IPPDRVEAAC QAVLELCRKE LPGDVLVFLP
301 SEEEISLCCE SLSREVESLL LQGLPPRVLP LHPDCGRAVQ AVYEDMDARK VVVTHWLADF
361 SFSLPSIQHV IDSGLELRSV YNPRIRAEFQ VLRPISKCQA EARRLRARGF PPGSCLCLYP
421 KSFLELEAPP LPQPRVCEEN LSSLVLLLKR RQIAEPGECH FLDQPAPEAL MQALEDLDYL
481 AALDDDGDLS DLGVILSEFP LAPELAKALL ASCEFDCVDE MLTLAAMLTA APGFTRPPLS
541 AEEAALRRAL EHTDGDHSSL IQVYEAFIQS GADEAWCQAR GLNWAALCQA HKLRGELLEL
601 MQRIELPLSL PAFGSEQNRR DLQKALVSGY FLKVARDTDG TGNYLLLTHK HVAQLSSYCC
661 YRSRRAPARP PPWVLYHNFT ISKDNCLSIV SEIQPQMLVE LAPPYFLSNL PPSESRDLLN
721 QLREGMADST AGSKSSSAQE FRDPCVLQ
```

Figure 3N.1 185P2C9 v.1 amino acid sequence (SEQ ID NO:75) of 1307 amino acids.

```
   1 MEDMRGQQER EGPGRDHAPS IPTSPFGDSL ESSTELRRHL QFVEEEAELL RRSISEIEDH
  61 NRQLTHELSK FKFEPPREPG WLGEGASPGA GGGAPLQEEL KSARLQISEL SGKVLKLQHE
 121 NHALLSNIQR CDLAAHLGLR APSPRDSDAE SDAGKKESDG EESRLPQPKR EGPVGGESDS
 181 EEMFEKTSGF GSGKPSEASE PCPTELLKAR EDSEYLVTLK HEAQRLERTV ERLITDTDSF
 241 LHDAGLRGGA PLPGPGLQGE EEQGEGDQQE PQLLGTINAK MKAFKKELQA FLEQVNRIGD
 301 GLSPLPHLTE SSSFLSTVTS VSRDSPIGNL GKELGPDLQS RLKEQLEWQL GPARGDERES
 361 LRLRAARELH RRADGDTGSH GLGGQTCFSL EMEEEHLYAL RWKELEMHSL ALQNTLHERT
 421 WSDEKNLMQQ ELRSLKQNIF LFYVKLRWLL KHWRQGKQME EEGEEFTEGE HPETLSRLGE
 481 LGVQGGHQAD GPDHDSDRGC GFPVGEHSPH SRVQIGDHSL RLQTADRGQP HKQVVENQQL
 541 FSAFKALLED FRAELREDER ARLRLQQQYA SDKAAWDVEW AVLKCRLEQL EEKTENKLGE
 601 LGSSAESKGA LKKEREVHQK LLADSHSLVM DLRWQIHHSE KNWNREKVEL LDRLDRDRQE
 661 WERQKKEFLW RIEQLQKENS PRRGGSFLCD QKDGNVRPFP HQGSLRMPRP VAMWPCADAD
 721 SIPFEDRPLS KLKESDRCSA SENLYLDALS LDDEPEEPPA HRPEREFRNR LPEEEENHKG
 781 NLQRAVSVSS MSEFQRLMDI SPFLPEKGLP STSSKEDVTP PLSPDDLKYI EEFNKSWDYT
 841 PNRGHNGGGP DLWADRTEVG RAGHEDSTEP FPDSSWYLTT SVTMTTDTMT SPEHCQKQPL
 901 RSHVLTEQSG LRVLHSPPAV RRVDSITAAG GEGPFPTSRA RGSPGDTKGG PPEPMLSRWP
 961 CTSPRHSRDY VEGARRPLDS PLCTSLGFAS PLHSLEMSKN LSDDMKEVAF SVRNAICSGP
1021 GELQVKDMAC QTNGSRTMGT QTVQTISVGL QTEALRGSGV TSSPHKCLTP KAGGGATPVS
1081 SPSRSLRSRQ VAPAIEKVQA KFERTCCSPK YGSPKLQRKP LPKADQPNNR TSPGMAQKGY
1141 SESAWARSTT TRESPVHTTI NDGLSSLFNI IDHSPVVQDP FQKGLRAGSR SRSAEPRPEL
1201 GPGQETGTNS RGRSPSPIGV GSEMCREEGG EGTPVKQDLS APPGYTLTEN VARILNKKLL
1261 EHALKEERRQ AAHGPPGLHS DSHSLGDTAE PGPMENQTVL LTAPWGL
```

Figure 3N.2 185P2C9 v.2 clone 1 amino acid sequence (SEQ ID NO:76) of 1142 amino acids.

```
   1 MEDTRGQQER EGPGRDHAPS IPTSPFGDSL ESSTELRRHL QFVEEEAELL RRSISEIEDH
  61 NRQLTHELSK FKFEPPREPG WLGEGASPGA GGGAPLQEEL KSARLQISEL SGKVLKLQHE
 121 NHALLSNIQR CDLAAHLGLR APSPRDSDAE SDAGKKESDG EESRLPQPKR EGPVGGESDS
 181 EEMFEKTSGF GSGKPSEASE PCPTELLKAR EDSEYLVTLK HEAQRLERTV ERLITDTDSF
 241 LHDAGLRGGA PLPGPGLQGE EEQGEGDQQE PQLLGTINAK MKAFKKELQA FLQQVNRIGD
 301 GLSPLPHLTE SSSFLSTVTS VSRDSPIGNL GKELGPDLQS RLKEQLEWQL GPAQGDERES
 361 LRLRAARELH RRADGDTGSH GLGGQTCFSL EMEEEHLYAL RWKELEMHSL ALQNTLHERT
 421 WSDEKNLMQQ ELRSLKQNIF LFYVKLRWLL KHWRQGKQME EEGEEFTEGE HPETLSRLGE
 481 LGVQGGHQAD GPDHDSDRGC GFPVGEHSPH SRVQIGDHSL RLQTADRGQP HKQVVENQQL
 541 FSAFKALLED FRAELREDER ARLRLQQQYA SDKAAWDVEW AVLKCRLEQL EEKTENKLGE
 601 LGSSAESKGA LKKEREVHQK LLADSHSLVM DLRWQIHHSE KNWNREKVEL LDRLDRDRQE
 661 WERQKKEFLW RIEQLQKENS PRRGGSFLCD QKDGNVRPFP HQGSLRMPRP VAMWPCADAD
 721 SIPFEDRPLS KLKESDRCSA SENLYLDALS LDDEPEEPPA HRPEREFRNR LPEEEENHKG
 781 NLQRAVSVSS MSEFQRLMDI SPFLPEKGLP STSSKEDVTP PLSPDDLKYI EEFNKSWDYT
 841 PNRGHNGGGP DLWADRTEVG RAGHEDSTEP FPDSSWYLTT SVTMTTDTMT SPEHCQKQPL
 901 RSHVLTEQSG LRVLHSPPAV RRVDSITAAG GEGPFPTSRA RGSPGDTKGG PPEPMLSRWP
 961 CTSPRHSRDY VEGARRPLDS PLCTSLGFAS PLHSLEMSKN LSDDMKEVAF SVRNAICSGP
1021 GELQVKDMAC QTNGSRTMGT QTVQTISVGL QTEALRGSGV TSSPHKCLTP KAGGGATPVS
1081 SPSRSLRSRQ VAPAIEKVQA KFERTCCSPK YGSPKLQRKP LPKADQPNNR PGNRHQFPRK
1141 VA
```

Figure 3N.3 185P2C9 v.3 clone 2 amino acid sequence ((SEQ ID NO:77) of 1313 amino acids.

```
   1 MEDTRGQQER EGPGRDHAPS IPTSPFGDSL ESSTELRRHL QFVEEEAELL RRSISEIEDH
  61 NRQLTHELSK FKFEPPREPG WLGEGASPGA GGGAPLQEEL KSARLQISEL SGKVLKLQHE
 121 NHALLSNIQR CDLAAHLGLR APSPRDSDAE SDAGKKESDG EESRLPQPKW EGPVGGESDS
 181 EEMFEKTSGF GSGKPSEASE PCPTELLKAR EDSEYLVTLK HEAQRLERTV ERLITDTDSF
 241 LHDAGLRGGA PLPGPGLQGE EEQGEGDQQE PQLLGTINAK MKAFKKELQA FLEQVNRIGD
 301 GLSPLPHLTE SSSFLSTVTS VSRDSPIGNL GKELGPDLQS RLKEQLEWQL GPARGDERES
 361 LRLRAARELH RRADGDTGSH GLGGQTCFSL EMEEEHLYAL RWKELEMHSL ALQNTLHERT
 421 WSDEKNLMQQ ELRSLKQNIF LFYVKLRWLL KHWRQGKQME EEGEEFTEGE HPETLSRLGE
 481 LGVQGGHQAD GPDHDSDRGC GFPVGEHSPH SRVQIGDHSL RLQTADRGQP HKQVVENQQL
 541 FSAFKALLED FRAELREDER ARLRLQQQYA SDKAAWDVEW AVLKCRLEQN CCGYPRINIE
 601 EETLGFTRLP AGSTVKTLKS LGLQRLELEE KTENKLGELG SSAESKGALK KEREVHQKLL
 661 ADSHSLVMDL RWQIHHSEKN WNREKVELLD RLDRDRQEWE RQKKEFLWRI EQGSLRMPRP
 721 VAMWPCADAD SIPFEDRPLS KLKESDRCSA SENLYLDALS LDDEPEEPPA HRPEREFRNR
 781 LPEEEENHKG NLQRAVSVSS MSEFQRLMDI SPFLPEKGLP STSSKEDVTP PLSPDDLKYI
 841 EEFNKSWDYT PNRGHNGGGP DLWADRTEVG RAGHEDSTEP FPDSSWYLTT SVTMTTDTMT
 901 SPEHCQKQPL RSHVLTEQSG LRVLHSPPAV RRVDSITAAG GEGPFPTSRA RGSPGDTKGG
 961 PPEPMLSRWP CTSPRHSRDY VEGARRPLDS PLCTSLGFAS PLHSLEMSKN LSDDMKEVAF
1021 SVRNAICSGP GELQVKDMAC QTNGSRTMGT QTVQTISVGL QTEALRGSGV TSSPHKCLTP
1081 KAGGGATPVS SPSRSLRSRQ VAPAIEKVQA KFERTCCSPK YGSPKLQRKP LPKADQPNNR
1141 TSPGMAQKGY SESAWARSTT TRESPVHTTI NDGLSSLFNI IDHSPVVQDP FQKGLRAGSR
1201 SRSAEPRPEL GPGQETGTNS RGRSPSPIGV GSEMCREEGG EGTPVKQDLS APPGYTLTEN
1261 VARILNKKLL EHALKEERRQ AAHGPPGLHS DSHSLGDTAE PGPMEELPCS ALA
```

Figure 3(O) 185P3C2 amino acid sequence (SEQ ID NO:78) of 551 amino acids.

```
   1 NCLLRPKNKS VRWGPGAGAA LLRPSPAALG AGSRACSVPP AAPAQTPRPQ VSAPAWGPGR
  61 AARGSGRMER RMKAGYLDQQ VPYTFSSKSP GNGSLREALI GPLGKLMDPG SLPPLDSEDL
 121 FQDLSHFQET WLAEAQVPDS DEQFVPDFHS ENLAFHSPTT RIKKEPQSPR TDPALSCSRK
 181 PPLPYHHGEQ CLYSSAYDPP RQIAIKSPAP GALGQSPLQP FPRAEQRNFL RSSGTSQPHP
 241 GHGYLGEHSS VFQQPLDICH SFTSQGGGRE PLPAPYQHQL SEPCPPYPQQ SFKQEYHDPL
 301 YEQAGQPAVD QGGVNGHRYP GAGVVIKQEQ TDFAYDSDVT GCASMYLHTE GFSGPSPGDG
 361 AMGYGYEKPL RPFPDDVCVV PEKFEGDIKQ EGVGAFREGP PYQRRGALQL WQFLVALLDD
 421 PTNAHFIAWT GRGMEFKLIE PEEVARLWGI QKNRPAMNYD KLSRSLRYYY EKGIMQKVAG
 481 ERYVYKFVCE PEALFSLAFP DNQRPALKAE FDRPVSEEDT VPLSHLDESP AYLPELAGPA
 541 QPFGPKGGYS Y
```

Figure 3P  186P1H9 amino acid sequence (SEQ ID NO:79) of 430 amino acids.

```
  1 MLALLAASVA LAVAAGAQDS PAPGSRFVCT ALPPEAVHAG CPLPAMPMQG GAQSPEEELR
 61 AAVLQLRETV VQQKETLASA RAIRELTGKL ARCEGLAGGK ARGAGATGKD TMGDLPRDPG
121 HVVEQLSRSL QTLKDRLESL EHQLRANVSN AGLPGDFREV LQQRLGELER QLLRKVAELE
181 DEKSLLHNET SAHRQKTEST LNALLQRVTE LERGNSAPKS PDAFKVSLPL RTNYLYGKIK
241 KTLPELYAFT ICLWLRSSAS PGIGTPFSYA VPGQANEILL IEWGNNPIEL LINDKVAQLP
301 LFVSDGKWHH ICVTWTTRDG MWEAFQDGEK LGTGENLAPW HPIKPGGVLI LGQEQDTVGG
361 RFDATQAFVG ELSQFNIWDR VLRAQEIVNI ANCSTNMPGN IIPWVDNNVD VFGGASKWPV
421 ETCEEALLDL
```

Figure 3Q  187P3F2 amino acid sequence (SEQ ID NO:80) of 500 amino acids.

```
  1 MATAASNPYL PGNSLLAAGS IVHSDAAGAG GGGGGGGGSG GGGAGGGGGG MQPGSAAVTS
 61 GAYRGDPSSV KMVQSDFMQG AMAASNGGHM LSHAHQWVTA LPHAAAAAAA AAAAAVEASS
121 PWSGSAVGMA GSPQQPPQPP PPPPQGPDVK GGAGRDDLHA GTALHHRGPP HLGPPPPPPH
181 QGHPGGWGAA AAAAAAAAAA AAAAHLPSMA GGQQPPPQSL LYSQPGGFTV NGMLSAPPGP
241 GGGGGAGGG AQSLVHPGLV RGDTPELAEH HHHHHHHAHP PPHPHHAQG PPHHGGGGGG
301 AGPGLNSHDP HSDEDTPTSD DLEQFAKQFK QRRIKLGFTQ ADVGLALGTL YGNVFSQTTI
361 CRFEALQLSF KNMCKLKPLL NKWLEEADSS TGSPTSIDKI AAQGRKRKKR TSIEVSVKGA
421 LESHFLKCPK PSAQEITNLA DSLQLEKEVV RVWFCNRRQK EKRMTPPGIQ QQTPDDVYSQ
481 VGTVSADTPP PHHGLQTSVQ
```

Figure 3R  192P2G7 amino acid sequence (SEQ ID NO:81) of 284 amino acids.

```
  1 MAESEAETPS TPGEFESKYF EFHGVRLPPF CRGKMEEIAN FPVRPSDVWI VTYPKSGTSL
 61 LQEVVYLVSQ GADPDEIGLM NIDEQLPVLE YPQPGLDIIK ELTSPRLIKS HLPYRFLPSD
121 LHNGDSKVIY MARNPKDLVV SYYQFHRSLR TMSYRGTFQE FCRRFMNDKL GYGSWFEHVQ
181 EFWEHRMDSN VLFLKYEDMH RDLVTMVEQL ARFLGVSCDK AQLEALTEHC HQLVDQCCNA
241 EALPVGRGRV GLWKDIFTVS MNEKFDLVYK QKMGKCDLTF DFYL
```

Figure 4:

74P3B3 (SEQ ID NO 82) Alignment with Gag-Pro-Pol-Env protein (SEQ ID NO 83).

```
 Score =  149 bits (375), Expect = 3e-35
 Identities = 92/219 (42%), Positives = 121/219 (55%), Gaps = 21/219 (9%)

Query: 5   KKGLEEQSAPHWDHPEWPPPIKQCSLEPWRSESQ-----ICPVSRMNELWPQEPQAHGVA 59
            K+  E ++ P    +  WPP   Q     P   ESQ      + P  +    +PQ P
Sbjct: 197 KQVKENKTQPPVAYQYWPPAELQYRPPP---ESQYGYPGMPPAPQGRAPYPQPPTR---- 249

Query: 60  PVQHKAALPSNVNESPLQPIIRQARLAGDLDAWQFAVVLQPPRQQGGAH-------QAVW 112
              +      P +   S L  II ++R  GD +AWQF + L+P      GA        +A +
Sbjct: 250 --RLNPTAPPSRQGSELHEIIDKSRKEGDTEAWQFPITLEPMPPGEGAQEGEPPTVEARY 307

Query: 113 EPFSFKLLKDLKAAVGQYGPNSPFIRSLLQSVAQNKLLTPCDWEILTKVTLSPSQFLQFK 172
            + FS K+LKD+K  V QYGPNSP++R+LL S+A    L P DWEIL K +LSPSQFLQFK
Sbjct: 308 KSFSIKMLKDMKEGVKQYGPNSPYMRTLLDSIAYGHRLIPYDWEILAKSSLSPSQFLQFK 367

Query: 173 TWWTDEAQNQDRKNRAANPAIAITFEQLLGIGGQWGTVN 211
            TWW D   Q Q R+NRAANP + I  +QLLGIG  W T++
Sbjct: 368 TWWIDGVQEQVRRNRAANPPVNIDADQLLGIGQNWSTIS 406
```

83P4B8 (SEQ ID NO 84) Alignment with KIAA1794 protein (SEQ ID NO 85).

```
 Score = 1416 bits (3665), Expect = 0.0
 Identities = 793/796 (99%), Positives = 796/796 (99%)

Query: 547  ANQLDARKSAVAGFLLLLKNFKVLGSLSSSQCSQSLSVSQVHVDVHSHYNSVANETFCLE 606
             A+QLDARKSAVAGFLLLLKNFKVLGSLSSSQCSQSLSVSQVHVDVHSHYNSVANETFCLE
Sbjct: 1    ASQLDARKSAVAGFLLLLKNFKVLGSLSSSQCSQSLSVSQVHVDVHSHYNSVANETFCLE 60

Query: 607  IMDSLRRCLSQQADVRLMLYEGFYDVLRRNSQLANSVMQTLLSQLKQFYEPKPDLLPPLK 666
             IMDSLRRCLSQQADVRLMLYEGFYDVLRRNSQLANSVMQTLLSQLKQFYEPKPDLLPPLK
Sbjct: 61   IMDSLRRCLSQQADVRLMLYEGFYDVLRRNSQLANSVMQTLLSQLKQFYEPKPDLLPPLK 120

Query: 667  LDACILTQGDKISLQEPLDYLLCCIQHCLAWYKNTVIPLQQGEEEEEEEEEAFYEDLDDIL 726
             L+ACILTQGDKISLQEPLDYLLCCIQHCLAWYKNTVIPLQQGEEEEEEEEEAFYEDLDDIL
Sbjct: 121  LEACILTQGDKISLQEPLDYLLCCIQHCLAWYKNTVIPLQQGEEEEEEEEEAFYEDLDDIL 180

Query: 727  ESITNRMIKSELEDFELDKSADFSQSTSIGIKNNISAFLVMGVCEVLIEYNFSISSFSKN 786
             ESITNRMIKSELEDFELDKSADFSQSTSIGIKNNISAFLVMGVCEVLIEYNFSISSFSKN
Sbjct: 181  ESITNRMIKSELEDFELDKSADFSQSTSIGIKNNISAFLVMGVCEVLIEYNFSISSFSKN 240

Query: 787  RFEDILSLFMCYKKLSDILNEKAGKAKTKMANKTSDSLLSMKFVSSLLTALFRDSIQSHQ 846
             RFEDILSLFMCYKKLSDILNEKAGKAKTKMANKTSDSLLSMKFVSSLLTALFRDSIQSHQ
Sbjct: 241  RFEDILSLFMCYKKLSDILNEKAGKAKTKMANKTSDSLLSMKFVSSLLTALFRDSIQSHQ 300
```

Figure 4 (continued)

```
Query: 847   ESLSVLRSSNEFMRYAVNVALQKVQQLKETGHVSGPDGQNPEKIFQNLCDITRVLLWRYT 906
             ESLSVLRSSNEFMRYAVNVALQKVQQLKETGHVSGPDGQNPEKIFQNLCD+TRVLLWRYT
Sbjct: 301   ESLSVLRSSNEFMRYAVNVALQKVQQLKETGHVSGPDGQNPEKIFQNLCDLTRVLLWRYT 360

Query: 907   SIPTSVEESGKKEKGKSISLLCLEGLQKIFSAVQQFYQPKIQQFLRALDVTDKEGEERED 966
             SIPTSVEESGKKEKGKSISLLCLEGLQKIFSAVQQFYQPKIQQFLRALDVTDKEGEERED
Sbjct: 361   SIPTSVEESGKKEKGKSISLLCLEGLQKIFSAVQQFYQPKIQQFLRALDVTDKEGEERED 420

Query: 967   ADVSVTQRTAFQIRQFQRSLLNLLSSQEEDFNSKEALLLVTVLTSLSKLLEPSSPQFVQM 1026
             ADVSVTQRTAFQIRQFQRSLLNLLSSQEEDFNSKEALLLVTVLTSLSKLLEPSSPQFVQM
Sbjct: 421   ADVSVTQRTAFQIRQFQRSLLNLLSSQEEDFNSKEALLLVTVLTSLSKLLEPSSPQFVQM 480

Query: 1027  LSWTSKICKENSREDALFCKSLMNLLFSLHVSYKSPVILLRDLSQDIHGHLGDIDQDVEV 1086
             LSWTSKICKENSREDALFCKSLMNLLFSLHVSYKSPVILLRDLSQDIHGHLGDIDQDVEV
Sbjct: 481   LSWTSKICKENSREDALFCKSLMNLLFSLHVSYKSPVILLRDLSQDIHGHLGDIDQDVEV 540

Query: 1087  EKTNHFAIVNLRTAAPTVCLLVLSQAEKVLEEVDWLITKLKGQVSQETLSEEASSQATLP 1146
             EKTNHFAIVNLRTAAPTVCLLVLSQAEKVLEEVDWLITKLKGQVSQETLSEEASSQATLP
Sbjct: 541   EKTNHFAIVNLRTAAPTVCLLVLSQAEKVLEEVDWLITKLKGQVSQETLSEEASSQATLP 600

Query: 1147  NQPVEKAIIMQLGTLLTFFHELVQTALPSGSCVDTLLKDLCKMYTTLTALVRYYLQVCQS 1206
             NQPVEKAIIMQLGTLLTFFHELVQTALPSGSCVDTLLKDLCKMYTTLTALVRYYLQVCQS
Sbjct: 601   NQPVEKAIIMQLGTLLTFFHELVQTALPSGSCVDTLLKDLCKMYTTLTALVRYYLQVCQS 660

Query: 1207  SGGIPKNMEKLVKLSGSHLTPLCYSFISYVQNKSKSLNYTGEKKEKPAAVATAMARVLRE 1266
             SGGIPKNMEKLVKLSGSHLTPLCYSFISYVQNKSKSLNYTGEKKEKPAAVATAMARVLRE
Sbjct: 661   SGGIPKNMEKLVKLSGSHLTPLCYSFISYVQNKSKSLNYTGEKKEKPAAVATAMARVLRE 720

Query: 1267  TKPIPNLIFAIEQYEKFLIHLSKKSKVNLMQHMKLSTSRDFKIKGNILDMVLREDGEDEN 1326
             TKPIPNLIFAIEQYEKFLIHLSKKSKVNLMQHMKLSTSRDFKIKGNILDMVLREDGEDEN
Sbjct: 721   TKPIPNLIFAIEQYEKFLIHLSKKSKVNLMQHMKLSTSRDFKIKGNILDMVLREDGEDEN 780

Query: 1327  EEGTASEHGGQNKEPA 1342
             EEGTASEHGGQNKEPA
Sbjct: 781   EEGTASEHGGQNKEPA 796
```

109P1D4 (SEQ ID NO 86) Alignment with protocadherin 11 (SEQ ID NO 87).
Score = 1896 bits (4912), Expect = 0.0
Identities = 1010/1011 (99%), Positives = 1010/1011 (99%)

```
Query: 1     MDLLSGTYIFAVLLACVVFHSGAQEKNYTIREEMPENVLIGDLLKDLNLSLIPNKSLTTA 60
             MDLLSGTYIFAVLLACVVFHSGAQEKNYTIREEMPENVLIGDLLKDLNLSLIPNKSLTTA
Sbjct: 1     MDLLSGTYIFAVLLACVVFHSGAQEKNYTIREEMPENVLIGDLLKDLNLSLIPNKSLTTA 60
```

Figure 4 (continued)

```
Query: 61    MQFKLVYKTGDVPLIRIEEDTGEIFTTGARIDREKLCAGIPRDEHCFYEVEVAILPDEIF 120
             MQFKLVYKTGDVPLIRIEEDTGEIFTTGARIDREKLCAGIPRDEHCFYEVEVAILPDEIF
Sbjct: 61    MQFKLVYKTGDVPLIRIEEDTGEIFTTGARIDREKLCAGIPRDEHCFYEVEVAILPDEIF 120

Query: 121   RLVKIRFLIEDINDNAPLFPATVINISIPENSAINSKYTLPAAVDPDVGINGVQNYELIK 180
             RLVKIRFLIEDINDNAPLFPATVINISIPENSAINSKYTLPAAVDPDVGINGVQNYELIK
Sbjct: 121   RLVKIRFLIEDINDNAPLFPATVINISIPENSAINSKYTLPAAVDPDVGINGVQNYELIK 180

Query: 181   SQNIFGLDVIETPEGDKMPQLIVQKELDREEKDTYVMKVKVEDGGFPQRSSTAILQVSVT 240
             SQNIFGLDVIETPEGDKMPQLIVQKELDREEKDTYVMKVKVEDGGFPQRSSTAILQVSVT
Sbjct: 181   SQNIFGLDVIETPEGDKMPQLIVQKELDREEKDTYVMKVKVEDGGFPQRSSTAILQVSVT 240

Query: 241   DTNDNHPVFKETEIEVSIPENAPVGTSVTQLHATDADIGENAKIHFSFSNLVSNIARRLF 300
             DTNDNHPVFKETEIEVSIPENAPVGTSVTQLHATDADIGENAKIHFSFSNLVSNIARRLF
Sbjct: 241   DTNDNHPVFKETEIEVSIPENAPVGTSVTQLHATDADIGENAKIHFSFSNLVSNIARRLF 300

Query: 301   HLNATTGLITIKEPLDREETPNHKLLVLASDGGLMPARAMVLVNVTDVNDNVPSIDIRYI 360
             HLNATTGLITIKEPLDREETPNHKLLVLASDGGLMPARAMVLVNVTDVNDNVPSIDIRYI
Sbjct: 301   HLNATTGLITIKEPLDREETPNHKLLVLASDGGLMPARAMVLVNVTDVNDNVPSIDIRYI 360

Query: 361   VNPVNDTVVLSENIPLNTKIALITVTDKDADHNGRVTCFTDHEIPFRLRPVFSNQFLLET 420
             VNPVNDTVVLSENIPLNTKIALITVTDKDADHNGRVTCFTDHEIPFRLRPVFSNQFLLET
Sbjct: 361   VNPVNDTVVLSENIPLNTKIALITVTDKDADHNGRVTCFTDHEIPFRLRPVFSNQFLLET 420

Query: 421   AAYLDYESTKEYAIKLLAADAGKPPLNQSAMLFIKVKDENDNAPVFTQSFVTVSIPENNS 480
             AAYLDYESTKEYAIKLLAADAGKPPLNQSAMLFIKVKDENDNAPVFTQSFVTVSIPENNS
Sbjct: 421   AAYLDYESTKEYAIKLLAADAGKPPLNQSAMLFIKVKDENDNAPVFTQSFVTVSIPENNS 480

Query: 481   PGIQLTKVSAMDADSGPNAKINYLLGPDAPPEFSLDCRTGMLTVVKKLDREKEDKYLFTI 540
             PGIQLTKVSAMDADSGPNAKINYLLGPDAPPEFSLDCRTGMLTVVKKLDREKEDKYLFTI
Sbjct: 481   PGIQLTKVSAMDADSGPNAKINYLLGPDAPPEFSLDCRTGMLTVVKKLDREKEDKYLFTI 540

Query: 541   LAKDNGVPPLTSNVTVFVSIIDQNDNSPVFTHNEYNFYVPENLPRHGTVGLITVTDPDYG 600
             LAKDNGVPPLTSNVTVFVSIIDQNDNSPVFTHNEYNFYVPENLPRHGTVGLITVTDPDYG
Sbjct: 541   LAKDNGVPPLTSNVTVFVSIIDQNDNSPVFTHNEYNFYVPENLPRHGTVGLITVTDPDYG 600

Query: 601   DNSAVTLSILDENDDFTIDSQTGVIRPNISFDREKQESYTFYVKAEDGGRVSRSSSAKVT 660
             DNSAVTLSILDENDDFTIDSQTGVIRPNISFDREKQESYTFYVKAEDGGRVSRSSSAKVT
Sbjct: 601   DNSAVTLSILDENDDFTIDSQTGVIRPNISFDREKQESYTFYVKAEDGGRVSRSSSAKVT 660

Query: 661   INVVDVNDNKPVFIVPPSNCSYELVLPSTNPGTVVFQVIAVDNDTGMNAEVCYSIVGGNT 720
             INVVDVNDNKPVFIVPPSNCSYELVLPSTNPGTVVFQVIAVDNDTGMNAEV YSIVGGNT
Sbjct: 661   INVVDVNDNKPVFIVPPSNCSYELVLPSTNPGTVVFQVIAVDNDTGMNAEVRYSIVGGNT 720

Query: 721   RDLFAIDQETGNITLMEKCDVTDLGLHRVLVKANDLGQPDSLFSVVIVNLFVNESVTNAT 780
```

Figure 4 (continued)

```
             RDLFAIDQETGNITLMEKCDVTDLGLHRVLVKANDLGQPDSLFSVVIVNLFVNESVTNAT
Sbjct: 721   RDLFAIDQETGNITLMEKCDVTDLGLHRVLVKANDLGQPDSLFSVVIVNLFVNESVTNAT 780

Query: 781   LINELVRKSTEAPVTPNTEIADVSSPTSDYVKILVAAVAGTITVVVVIFITAVVRCRQAP 840
             LINELVRKSTEAPVTPNTEIADVSSPTSDYVKILVAAVAGTITVVVVIFITAVVRCRQAP
Sbjct: 781   LINELVRKSTEAPVTPNTEIADVSSPTSDYVKILVAAVAGTITVVVVIFITAVVRCRQAP 840

Query: 841   HLKAAQKNKQNSEWATPNPENRQMIMMKKKKKKKKHSPKNLLLNFVTIEETKADDVDSDG 900
             HLKAAQKNKQNSEWATPNPENRQMIMMKKKKKKKKHSPKNLLLNFVTIEETKADDVDSDG
Sbjct: 841   HLKAAQKNKQNSEWATPNPENRQMIMMKKKKKKKKHSPKNLLLNFVTIEETKADDVDSDG 900

Query: 901   NRVTLDLPIDLEEQTMGKYNWVTTPTTFKPDSPDLARHYKSASPQPAFQIQPETPLNSKH 960
             NRVTLDLPIDLEEQTMGKYNWVTTPTTFKPDSPDLARHYKSASPQPAFQIQPETPLNSKH
Sbjct: 901   NRVTLDLPIDLEEQTMGKYNWVTTPTTFKPDSPDLARHYKSASPQPAFQIQPETPLNSKH 960

Query: 961   HIIQELPLDNTFVACDSISKCSSSSSDPYSVSDCGYPVTTFEVPVSVHTRP 1011
             HIIQELPLDNTFVACDSISKCSSSSSDPYSVSDCGYPVTTFEVPVSVHTRP
Sbjct: 961   HIIQELPLDNTFVACDSISKCSSSSSDPYSVSDCGYPVTTFEVPVSVHTRP 1011
```

154P2A8 (SEQ ID NO 88) Alignment with orphan G protein-coupled receptor 87 (SEQ ID NO 89).

Score = 526 bits (1356), Expect = e-149
Identities = 288/288 (100%), Positives = 288/288 (100%)

```
Query: 1    RNKTSFIFYLKNIVVADLIMTLTFPFRIVHDAGFGPWYFKFILCRYTSVLFYANMYTSIV 60
            RNKTSFIFYLKNIVVADLIMTLTFPFRIVHDAGFGPWYFKFILCRYTSVLFYANMYTSIV
Sbjct: 71   RNKTSFIFYLKNIVVADLIMTLTFPFRIVHDAGFGPWYFKFILCRYTSVLFYANMYTSIV 130

Query: 61   FLGLISIDRYLKVVKPFGDSRMYSITFTKVLSVCVWVIMAVLSLPNIILTNGQPTEDNIH 120
            FLGLISIDRYLKVVKPFGDSRMYSITFTKVLSVCVWVIMAVLSLPNIILTNGQPTEDNIH
Sbjct: 131  FLGLISIDRYLKVVKPFGDSRMYSITFTKVLSVCVWVIMAVLSLPNIILTNGQPTEDNIH 190

Query: 121  DCSKLKSPLGVKWHTAVTYVNSCLFVAVLVILIGCYIAISRYIHKSSRQFISQSSRKRKH 180
            DCSKLKSPLGVKWHTAVTYVNSCLFVAVLVILIGCYIAISRYIHKSSRQFISQSSRKRKH
Sbjct: 191  DCSKLKSPLGVKWHTAVTYVNSCLFVAVLVILIGCYIAISRYIHKSSRQFISQSSRKRKH 250

Query: 181  NQSIRVVVAVFFTCFLPYHLCRIPFTFSHLDRLLDESAQKILYYCKEITLFLSACNVCLD 240
            NQSIRVVVAVFFTCFLPYHLCRIPFTFSHLDRLLDESAQKILYYCKEITLFLSACNVCLD
Sbjct: 251  NQSIRVVVAVFFTCFLPYHLCRIPFTFSHLDRLLDESAQKILYYCKEITLFLSACNVCLD 310

Query: 241  PIIYFFMCRSFSRRLFKKSNIRTRSESIRSLQSVRRSEVRIYYDYTDV 288
            PIIYFFMCRSFSRRLFKKSNIRTRSESIRSLQSVRRSEVRIYYDYTDV
Sbjct: 311  PIIYFFMCRSFSRRLFKKSNIRTRSESIRSLQSVRRSEVRIYYDYTDV 358
```

Figure 4 (continued)

```
156P1D4 (SEQ ID NO 90) Alignment with kidney-specific membrane protein NX-17 (SEQ ID NO 91).
 Score =  424 bits (1089), Expect = e-118
 Identities = 222/222 (100%), Positives = 222/222 (100%)

Query: 1   MLWLLFFLVTAIHAELCQPGAENAFKVRLSIRTALGDKAYAWDTNEEYLFKAMVAFSMRK 60
            MLWLLFFLVTAIHAELCQPGAENAFKVRLSIRTALGDKAYAWDTNEEYLFKAMVAFSMRK
Sbjct: 1   MLWLLFFLVTAIHAELCQPGAENAFKVRLSIRTALGDKAYAWDTNEEYLFKAMVAFSMRK 60

Query: 61  VPNREATEISHVLLCNVTQRVSFWFVVTDPSKNHTLPAVEVQSAIRMNKNRINNAFFLND 120
            VPNREATEISHVLLCNVTQRVSFWFVVTDPSKNHTLPAVEVQSAIRMNKNRINNAFFLND
Sbjct: 61  VPNREATEISHVLLCNVTQRVSFWFVVTDPSKNHTLPAVEVQSAIRMNKNRINNAFFLND 120

Query: 121 QTLEFLKIPSTLAPPMDPSVPIWIIIFGVIFCIIIVAIALLILSGIWQRRRKNKEPSEVD 180
            QTLEFLKIPSTLAPPMDPSVPIWIIIFGVIFCIIIVAIALLILSGIWQRRRKNKEPSEVD
Sbjct: 121 QTLEFLKIPSTLAPPMDPSVPIWIIIFGVIFCIIIVAIALLILSGIWQRRRKNKEPSEVD 180

Query: 181 DAEDKCENMITIENGIPSDPLDMKGGHINDAFMTEDERLTPL 222
            DAEDKCENMITIENGIPSDPLDMKGGHINDAFMTEDERLTPL
Sbjct: 181 DAEDKCENMITIENGIPSDPLDMKGGHINDAFMTEDERLTPL 222


156P5C12 (SEQ ID NO 92) Alignment with N-ACETYLTRANSFERASE CML1 (SEQ ID NO 93).
Score =  416 bits (1070), Expect = e-116
 Identities = 227/227 (100%), Positives = 227/227 (100%)

Query: 1   MAPCHIRKYQESDRQWVVGLLSRGMAEHAPATFRQLLKLPRTLILLLGGPLALLLVSGSW 60
            MAPCHIRKYQESDRQWVVGLLSRGMAEHAPATFRQLLKLPRTLILLLGGPLALLLVSGSW
Sbjct: 1   MAPCHIRKYQESDRQWVVGLLSRGMAEHAPATFRQLLKLPRTLILLLGGPLALLLVSGSW 60

Query: 61  LLALVFSISLFPALWFLAKKPWTEYVDMTLCTDMSDITKSYLSERGSCFWVAESEEKVVG 120
            LLALVFSISLFPALWFLAKKPWTEYVDMTLCTDMSDITKSYLSERGSCFWVAESEEKVVG
Sbjct: 61  LLALVFSISLFPALWFLAKKPWTEYVDMTLCTDMSDITKSYLSERGSCFWVAESEEKVVG 120

Query: 121 MVGALPVDDPTLREKRLQLFHLSVDSEHRRQGIAKALVRTVLQFARDQGYSEVILDTGTI 180
            MVGALPVDDPTLREKRLQLFHLSVDSEHRRQGIAKALVRTVLQFARDQGYSEVILDTGTI
Sbjct: 121 MVGALPVDDPTLREKRLQLFHLSVDSEHRRQGIAKALVRTVLQFARDQGYSEVILDTGTI 180

Query: 181 QLSAMALYQSMGFKKTGQSFFCVWARLVALHTVHFIYHLPSSKVGSL 227
            QLSAMALYQSMGFKKTGQSFFCVWARLVALHTVHFIYHLPSSKVGSL
Sbjct: 181 QLSAMALYQSMGFKKTGQSFFCVWARLVALHTVHFIYHLPSSKVGSL 227

161P2B7a (SEQ ID NO 94) Alignment with OG-12b homeodomain protein (SEQ ID NO 95).
 Score =  283 bits (723), Expect = 9e-76
 Identities = 190/190 (100%), Positives = 190/190 (100%)
```

Figure 4 (continued)

```
Query: 1    MEDEGQTKIKQRRSRTNFTLEQLNELERLFDETHYPDAFMREELSQRLGLSEARVQVWFQ 60
            MEDEGQTKIKQRRSRTNFTLEQLNELERLFDETHYPDAFMREELSQRLGLSEARVQVWFQ
Sbjct: 9    MEDEGQTKIKQRRSRTNFTLEQLNELERLFDETHYPDAFMREELSQRLGLSEARVQVWFQ 68

Query: 61   NRRAKCRKQENQLHKGVLIGAASQFEACRVAPYVNVGALRMPFQQVQAQLQLDSAVAHAH 120
            NRRAKCRKQENQLHKGVLIGAASQFEACRVAPYVNVGALRMPFQQVQAQLQLDSAVAHAH
Sbjct: 69   NRRAKCRKQENQLHKGVLIGAASQFEACRVAPYVNVGALRMPFQQVQAQLQLDSAVAHAH 128

Query: 121 HHLHPHLAAHAPYMMFPAPPFGLPLATLAADSASAASVVAAAAAAKTTSKNSSIADLRLK 180
            HHLHPHLAAHAPYMMFPAPPFGLPLATLAADSASAASVVAAAAAAKTTSKNSSIADLRLK
Sbjct: 129 HHLHPHLAAHAPYMMFPAPPFGLPLATLAADSASAASVVAAAAAAKTTSKNSSIADLRLK 188

Query: 181 AKKHAAALGL 190
            AKKHAAALGL
Sbjct: 189 AKKHAAALGL 198
```

179P3G7- (SEQ ID NO 96) Alignment with homeo box C10 (SEQ ID NO 97).
Score = 619 bits (1595), Expect = e-176
Identities = 342/342 (100%), Positives = 342/342 (100%)

```
Query: 1    MTCPRNVTPNSYAEPLAAPGGGERYSRSAGMYMQSGSDFNCGVMRGCGLAPSLSKRDEGS 60
            MTCPRNVTPNSYAEPLAAPGGGERYSRSAGMYMQSGSDFNCGVMRGCGLAPSLSKRDEGS
Sbjct: 1    MTCPRNVTPNSYAEPLAAPGGGERYSRSAGMYMQSGSDFNCGVMRGCGLAPSLSKRDEGS 60

Query: 61   SPSLALNTYPSYLSQLDSWGDPKAAYRLEQPVGRPLSSCSYPPSVKEENVCCMYSAENRA 120
            SPSLALNTYPSYLSQLDSWGDPKAAYRLEQPVGRPLSSCSYPPSVKEENVCCMYSAENRA
Sbjct: 61   SPSLALNTYPSYLSQLDSWGDPKAAYRLEQPVGRPLSSCSYPPSVKEENVCCMYSAENRA 120

Query: 121 KSGPEAALYSHPLPESCLGEHEVPVPSYYRASPSYSALDKTPHCSGANDFEAPFEQRASL 180
            KSGPEAALYSHPLPESCLGEHEVPVPSYYRASPSYSALDKTPHCSGANDFEAPFEQRASL
Sbjct: 121 KSGPEAALYSHPLPESCLGEHEVPVPSYYRASPSYSALDKTPHCSGANDFEAPFEQRASL 180

Query: 181 NPRAEHLESPQLGGKVSFPETPKSDSQTPSPNEIKTEQSLAGPKGSPSESEKERAKAADS 240
            NPRAEHLESPQLGGKVSFPETPKSDSQTPSPNEIKTEQSLAGPKGSPSESEKERAKAADS
Sbjct: 181 NPRAEHLESPQLGGKVSFPETPKSDSQTPSPNEIKTEQSLAGPKGSPSESEKERAKAADS 240

Query: 241 SPDTSDNEAKEEIKAENTTGNWLTAKSGRKKRCPYTKHQTLELEKEFLFNMYLTRERRLE 300
            SPDTSDNEAKEEIKAENTTGNWLTAKSGRKKRCPYTKHQTLELEKEFLFNMYLTRERRLE
Sbjct: 241 SPDTSDNEAKEEIKAENTTGNWLTAKSGRKKRCPYTKHQTLELEKEFLFNMYLTRERRLE 300

Query: 301 ISKTINLTDRQVKIWFQNRRMKLKKMNRENRIRELTSNFNFT 342
            ISKTINLTDRQVKIWFQNRRMKLKKMNRENRIRELTSNFNFT
Sbjct: 301 ISKTINLTDRQVKIWFQNRRMKLKKMNRENRIRELTSNFNFT 342
```

Figure 4 (continued)

184P3C10B (SEQ ID NO 98) Alignment with type II membrane protein (SEQ ID NO 99).

```
 Score =  720 bits (1859), Expect = 0.0
 Identities = 372/372 (100%), Positives = 372/372 (100%)

Query: 1    MKYLRHRRPNATLILAIGAFTLLLFSLLVSPPTCKVQEQPPAIPEALAWPTPPTRPAPAP 60
            MKYLRHRRPNATLILAIGAFTLLLFSLLVSPPTCKVQEQPPAIPEALAWPTPPTRPAPAP
Sbjct: 1    MKYLRHRRPNATLILAIGAFTLLLFSLLVSPPTCKVQEQPPAIPEALAWPTPPTRPAPAP 60

Query: 61   CHANTSMVTHPDFATQPQHVQNFLLYRHCRHFPLLQDVPPSKCAQPVFLLLVIKSSPSNY 120
            CHANTSMVTHPDFATQPQHVQNFLLYRHCRHFPLLQDVPPSKCAQPVFLLLVIKSSPSNY
Sbjct: 61   CHANTSMVTHPDFATQPQHVQNFLLYRHCRHFPLLQDVPPSKCAQPVFLLLVIKSSPSNY 120

Query: 121  VRRELLRRTWGRERKVRGLQLRLLFLVGTASNPHEARKVNRLLELEAQTHGDILQWDFHD 180
            VRRELLRRTWGRERKVRGLQLRLLFLVGTASNPHEARKVNRLLELEAQTHGDILQWDFHD
Sbjct: 121  VRRELLRRTWGRERKVRGLQLRLLFLVGTASNPHEARKVNRLLELEAQTHGDILQWDFHD 180

Query: 181  SFFNLTLKQVLFLQWQETRCANASFVLNGDDDVFAHTDNMVFYLQDHDPGRHLFVGQLIQ 240
            SFFNLTLKQVLFLQWQETRCANASFVLNGDDDVFAHTDNMVFYLQDHDPGRHLFVGQLIQ
Sbjct: 181  SFFNLTLKQVLFLQWQETRCANASFVLNGDDDVFAHTDNMVFYLQDHDPGRHLFVGQLIQ 240

Query: 241  NVGPIRAFWSKYYVPEVVTQNERYPPYCGGGGFLLSRFTAAALRRAAHVLDIFPIDDVFL 300
            NVGPIRAFWSKYYVPEVVTQNERYPPYCGGGGFLLSRFTAAALRRAAHVLDIFPIDDVFL
Sbjct: 241  NVGPIRAFWSKYYVPEVVTQNERYPPYCGGGGFLLSRFTAAALRRAAHVLDIFPIDDVFL 300

Query: 301  GMCLELEGLKPASHSGIRTSGVRAPSQHLSSFDPCFYRDLLLVHRFLPYEMLLMWDALNQ 360
            GMCLELEGLKPASHSGIRTSGVRAPSQHLSSFDPCFYRDLLLVHRFLPYEMLLMWDALNQ
Sbjct: 301  GMCLELEGLKPASHSGIRTSGVRAPSQHLSSFDPCFYRDLLLVHRFLPYEMLLMWDALNQ 360

Query: 361  PNLTCGNQTQIY 372
            PNLTCGNQTQIY
Sbjct: 361  PNLTCGNQTQIY 372
```

185P3C2 (SEQ ID NO 100) Alignment with E1A ENHANCER BINDING FACTOR (SEQ ID NO 101).

```
Query: 1    NCLLRPKNKSVRWGPGAGAALLRPSPAALGAGSRACSVPPAAPAQTPRPQVSAPAWGPGR 60
            NCLLRPKNKSVRWGPGAGAALLRPSPAALGAGSRACSVPPAAPAQTPRPQVSAPAWGPGR
Sbjct: 1    NCLLRPKNKSVRWGPGAGAALLRPSPAALGAGSRACSVPPAAPAQTPRPQVSAPAWGPGR 60

Query: 61   AARGSGRMERRMKAGYLDQQVPYTFSSKSPGNGSLREALIGPLGKLMDPGSLPPLDSEDL 120
            AARGSGRMERRMKAGYLDQQVPYTFSSKSPGNGSLREALIGPLGKLMDPGSLPPLDSEDL
Sbjct: 61   AARGSGRMERRMKAGYLDQQVPYTFSSKSPGNGSLREALIGPLGKLMDPGSLPPLDSEDL 120

Query: 121  FQDLSHFQETWLAEAQVPDSDEQFVPDFHSENLAFHSPTTRIKKEPQSPRTDPALSCSRK 180
            FQDLSHFQETWLAEAQVPDSDEQFVPDFHSENLAFHSPTTRIKKEPQSPRTDPALSCSRK
```

Figure 4 (continued)

```
Sbjct: 121 FQDLSHFQETWLAEAQVPDSDEQFVPDFHSENLAFHSPTTRIKKEPQSPRTDPALSCSRK 180

Query: 181 PPLPYHHGEQCLYSSAYDPPRQIAIKSPAPGALGQSPLQPFPRAEQRNFLRSSGTSQPHP 240
           PPLPYHHGEQCLYSSAYDPPRQIAIKSPAPGALGQSPLQPFPRAEQRNFLRSSGTSQPHP
Sbjct: 181 PPLPYHHGEQCLYSSAYDPPRQIAIKSPAPGALGQSPLQPFPRAEQRNFLRSSGTSQPHP 240

Query: 241 GHGYLGEHSSVFQQPLDICHSFTSQGGGREPLPAPYQHQLSEPCPPYPQQSFKQEYHDPL 300
           GHGYLGEHSSVFQQPLDICHSFTSQGGGREPLPAPYQHQLSEPCPPYPQQSFKQEYHDPL
Sbjct: 241 GHGYLGEHSSVFQQPLDICHSFTSQGGGREPLPAPYQHQLSEPCPPYPQQSFKQEYHDPL 300

Query: 301 YEQAGQPAVDQGGVNGHRYPGAGVVIKQEQTDFAYDSDVTGCASMYLHTEGFSGPSPGDG 360
           YEQAGQPAVDQGGVNGHRYPGAGVVIKQEQTDFAYDSDVTGCASMYLHTEGFSGPSPGDG
Sbjct: 301 YEQAGQPAVDQGGVNGHRYPGAGVVIKQEQTDFAYDSDVTGCASMYLHTEGFSGPSPGDG 360

Query: 361 AMGYGYEKPLRPFPDDVCVVPEKFEGDIKQEGVGAFREGPPYQRRGALQLWQFLVALLDD 420
           AMGYGYEKPLRPFPDDVCVVPEKFEGDIKQEGVGAFREGPPYQRRGALQLWQFLVALLDD
Sbjct: 361 AMGYGYEKPLRPFPDDVCVVPEKFEGDIKQEGVGAFREGPPYQRRGALQLWQFLVALLDD 420

Query: 421 PTNAHFIAWTGRGMEFKLIEPEEVARLWGIQKNRPAMNYDKLSRSLRYYYEKGIMQKVAG 480
           PTNAHFIAWTGRGMEFKLIEPEEVARLWGIQKNRPAMNYDKLSRSLRYYYEKGIMQKVAG
Sbjct: 421 PTNAHFIAWTGRGMEFKLIEPEEVARLWGIQKNRPAMNYDKLSRSLRYYYEKGIMQKVAG 480

Query: 481 ERYVYKFVCEPEALFSLAFPDNQRPALKAEFDRPVSEEDTVPLSHLDESPAYLPELAGPA 540
           ERYVYKFVCEPEALFSLAFPDNQRPALKAEFDRPVSEEDTVPLSHLDESPAYLPELAGPA
Sbjct: 481 ERYVYKFVCEPEALFSLAFPDNQRPALKAEFDRPVSEEDTVPLSHLDESPAYLPELAGPA 540

Query: 541 QPFGPKGGYSY 551
           QPFGPKGGYSY
Sbjct: 541 QPFGPKGGYSY 551
```

186P1H9-PENTRAXIN II (SEQ ID NO 102).
gi|9931976|gb|AAA68980.2| neuronal pentraxin II [Homo sapiens], 430 amino acids, 2F6 checksum.

```
MLALLAASVALAVAAGAQDSPAPGSRFVCTALPPEAVHAGCPLPAMPMQG
GAQSPEEELRAAVLQLRETVVQQKETLASARAIRELTGKLARCEGLAGGK
ARGAGATGKDTMGDLPRDPGHVVEQLSRSLQTLKDRLESLEHQLRANVSN
AGLPGDFREVLQQRLGELERQLLRKVAELEDEKSLLHNETSAHRQKTEST
LNALLQRVTELERGNSAFKSPDAFKVSLPLRTNYLYGKIKKTLPELYAFT
ICLWLRSSASPGIGTPFSYAVPGQANEILLIEWGNNPIELLINDKVAQLP
LFVSDGKWHHICVTWTTRDGMWEAFQDGEKLGTGENLAPWHPIKPGGVLI
LGQEQDTVGGRFDATQAFVGELSQFNIWDRVLRAQEIVNIANCSTNMPGN
IIPWVDNNVDVFGGASKWPVETCEEALLDL
```

Figure 4 (continued)

```
192P2G7 (SEQ ID NO 103) Alignment with sulfotransferase-related protein (SEQ ID NO 104).
 Score =  591 bits (1524), Expect = e-168
 Identities = 284/284 (100%), Positives = 284/284 (100%)

Query: 1    MAESEAETPSTPGEFESKYFEFHGVRLPPFCRGKMEEIANFPVRPSDVWIVTYPKSGTSL 60
            MAESEAETPSTPGEFESKYFEFHGVRLPPFCRGKMEEIANFPVRPSDVWIVTYPKSGTSL
Sbjct: 1    MAESEAETPSTPGEFESKYFEFHGVRLPPFCRGKMEEIANFPVRPSDVWIVTYPKSGTSL 60

Query: 61   LQEVVYLVSQGADPDEIGLMNIDEQLPVLEYPQPGLDIIKELTSPRLIKSHLPYRFLPSD 120
            LQEVVYLVSQGADPDEIGLMNIDEQLPVLEYPQPGLDIIKELTSPRLIKSHLPYRFLPSD
Sbjct: 61   LQEVVYLVSQGADPDEIGLMNIDEQLPVLEYPQPGLDIIKELTSPRLIKSHLPYRFLPSD 120

Query: 121  LHNGDSKVIYMARNPKDLVVSYYQFHRSLRTMSYRGTFQEFCRRFMNDKLGYGSWFEHVQ 180
            LHNGDSKVIYMARNPKDLVVSYYQFHRSLRTMSYRGTFQEFCRRFMNDKLGYGSWFEHVQ
Sbjct: 121  LHNGDSKVIYMARNPKDLVVSYYQFHRSLRTMSYRGTFQEFCRRFMNDKLGYGSWFEHVQ 180

Query: 181  EFWEHRMDSNVLFLKYEDMHRDLVTMVEQLARFLGVSCDKAQLEALTEHCHQLVDQCCNA 240
            EFWEHRMDSNVLFLKYEDMHRDLVTMVEQLARFLGVSCDKAQLEALTEHCHQLVDQCCNA
Sbjct: 181  EFWEHRMDSNVLFLKYEDMHRDLVTMVEQLARFLGVSCDKAQLEALTEHCHQLVDQCCNA 240

Query: 241  EALPVGRGRVGLWKDIFTVSMNEKFDLVYKQKMGKCDLTFDFYL 284
            EALPVGRGRVGLWKDIFTVSMNEKFDLVYKQKMGKCDLTFDFYL
Sbjct: 241  EALPVGRGRVGLWKDIFTVSMNEKFDLVYKQKMGKCDLTFDFYL 284


187P3F2 (SEQ ID NO 105) Alignment with POU domain, class 3, transcription factor 3 (SEQ ID NO 106).
 Score =  616 bits (1589), Expect = e-175
 Identities = 499/500 (99%), Positives = 499/500 (99%)

Query: 1    MATAASNPYLPGNSLLAAGSIVHSDAAGAGGGGGGGGGSGGGGAGGGGGGMQPGSAAVTS 60
            MATAASNPYLPGNSLLAAGSIVHSDAAGAGGGGGGGGG GGGGAGGGGGGMQPGSAAVTS
Sbjct: 1    MATAASNPYLPGNSLLAAGSIVHSDAAGAGGGGGGGGGGGGGGAGGGGGGMQPGSAAVTS 60

Query: 61   GAYRGDPSSVKMVQSDFMQGAMAASNGGHMLSHAHQWVTALPHAAAAAAAAAAAAVEASS 120
            GAYRGDPSSVKMVQSDFMQGAMAASNGGHMLSHAHQWVTALPHAAAAAAAAAAAAVEASS
Sbjct: 61   GAYRGDPSSVKMVQSDFMQGAMAASNGGHMLSHAHQWVTALPHAAAAAAAAAAAAVEASS 120

Query: 121  PWSGSAVGMAGSPQQPPQPPPPPPQGPDVKGGAGRDDLHAGTALHHRGPPHLGPPPPPPH 180
            PWSGSAVGMAGSPQQPPQPPPPPPQGPDVKGGAGRDDLHAGTALHHRGPPHLGPPPPPPH
Sbjct: 121  PWSGSAVGMAGSPQQPPQPPPPPPQGPDVKGGAGRDDLHAGTALHHRGPPHLGPPPPPPH 180

Query: 181  QGHPGGWGAAAAAAAAAAAAAAAAHLPSMAGGQQPPPQSLLYSQPGGFTVNGMLSAPPGP 240
            QGHPGGWGAAAAAAAAAAAAAAAAHLPSMAGGQQPPPQSLLYSQPGGFTVNGMLSAPPGP
Sbjct: 181  QGHPGGWGAAAAAAAAAAAAAAAAHLPSMAGGQQPPPQSLLYSQPGGFTVNGMLSAPPGP 240
```

Figure 4 (continued)

```
Query: 241 GGGGGGAGGGAQSLVHPGLVRGDTPELAEHHHHHHHHAHPHPPHPHHAQGPPHHGGGGGG 300
           GGGGGGAGGGAQSLVHPGLVRGDTPELAEHHHHHHHHAHPHPPHPHHAQGPPHHGGGGGG
Sbjct: 241 GGGGGGAGGGAQSLVHPGLVRGDTPELAEHHHHHHHHAHPHPPHPHHAQGPPHHGGGGGG 300

Query: 301 AGPGLNSHDPHSDEDTPTSDDLEQFAKQFKQRRIKLGFTQADVGLALGTLYGNVFSQTTI 360
           AGPGLNSHDPHSDEDTPTSDDLEQFAKQFKQRRIKLGFTQADVGLALGTLYGNVFSQTTI
Sbjct: 301 AGPGLNSHDPHSDEDTPTSDDLEQFAKQFKQRRIKLGFTQADVGLALGTLYGNVFSQTTI 360

Query: 361 CRFEALQLSFKNMCKLKPLLNKWLEEADSSTGSPTSIDKIAAQGRKRKKRTSIEVSVKGA 420
           CRFEALQLSFKNMCKLKPLLNKWLEEADSSTGSPTSIDKIAAQGRKRKKRTSIEVSVKGA
Sbjct: 361 CRFEALQLSFKNMCKLKPLLNKWLEEADSSTGSPTSIDKIAAQGRKRKKRTSIEVSVKGA 420

Query: 421 LESHFLKCPKPSAQEITNLADSLQLEKEVVRVWFCNRRQKEKRMTPPGIQQQTPDDVYSQ 480
           LESHFLKCPKPSAQEITNLADSLQLEKEVVRVWFCNRRQKEKRMTPPGIQQQTPDDVYSQ
Sbjct: 421 LESHFLKCPKPSAQEITNLADSLQLEKEVVRVWFCNRRQKEKRMTPPGIQQQTPDDVYSQ 480

Query: 481 VGTVSADTPPPHHGLQTSVQ 500
           VGTVSADTPPPHHGLQTSVQ
Sbjct: 481 VGTVSADTPPPHHGLQTSVQ 500
```

185P2C9 v.1 (SEQ ID NO 107) Alignment with KIAA0802 protein (SEQ ID NO 108).
Score = 2335 bits (6052), Expect = 0.0
Identities = 1307/1307 (100%), Positives = 1307/1307 (100%)

```
Query: 1     MEDMRGQQEREGPGRDHAPSIPTSPFGDSLESSTELRRHLQFVEEEAELLRRSISEIEDH 60
             MEDMRGQQEREGPGRDHAPSIPTSPFGDSLESSTELRRHLQFVEEEAELLRRSISEIEDH
Sbjct: 1     MEDMRGQQEREGPGRDHAPSIPTSPFGDSLESSTELRRHLQFVEEEAELLRRSISEIEDH 60

Query: 61    NRQLTHELSKFKFEPPREPGWLGEGASPGAGGGAPLQEELKSARLQISELSGKVLKLQHE 120
             NRQLTHELSKFKFEPPREPGWLGEGASPGAGGGAPLQEELKSARLQISELSGKVLKLQHE
Sbjct: 61    NRQLTHELSKFKFEPPREPGWLGEGASPGAGGGAPLQEELKSARLQISELSGKVLKLQHE 120

Query: 121   NHALLSNIQRCDLAAHLGLRAPSPRDSDAESDAGKKESDGEESRLPQPKREGPVGGESDS 180
             NHALLSNIQRCDLAAHLGLRAPSPRDSDAESDAGKKESDGEESRLPQPKREGPVGGESDS
Sbjct: 121   NHALLSNIQRCDLAAHLGLRAPSPRDSDAESDAGKKESDGEESRLPQPKREGPVGGESDS 180

Query: 181   EEMFEKTSGFGSGKPSEASEPCPTELLKAREDSEYLVTLKHEAQRLERTVERLITDTDSF 240
             EEMFEKTSGFGSGKPSEASEPCPTELLKAREDSEYLVTLKHEAQRLERTVERLITDTDSF
Sbjct: 181   EEMFEKTSGFGSGKPSEASEPCPTELLKAREDSEYLVTLKHEAQRLERTVERLITDTDSF 240

Query: 241   LHDAGLRGGAPLPGPGLQGEEEQGEGDQQEPQLLGTINAKMKAFKKELQAFLEQVNRIGD 300
             LHDAGLRGGAPLPGPGLQGEEEQGEGDQQEPQLLGTINAKMKAFKKELQAFLEQVNRIGD
Sbjct: 241   LHDAGLRGGAPLPGPGLQGEEEQGEGDQQEPQLLGTINAKMKAFKKELQAFLEQVNRIGD 300

Query: 301   GLSPLPHLTESSSFLSTVTSVSRDSPIGNLGKELGPDLQSRLKEQLEWQLGPARGDERES 360
```

Figure 4 (continued)

```
             GLSPLPHLTESSSFLSTVTSVSRDSPIGNLGKELGPDLQSRLKEQLEWQLGPARGDERES
Sbjct: 301   GLSPLPHLTESSSFLSTVTSVSRDSPIGNLGKELGPDLQSRLKEQLEWQLGPARGDERES 360

Query: 361   LRLRAARELHRRADGDTGSHGLGGQTCFSLEMEEEHLYALRWKELEMHSLALQNTLHERT 420
             LRLRAARELHRRADGDTGSHGLGGQTCFSLEMEEEHLYALRWKELEMHSLALQNTLHERT
Sbjct: 361   LRLRAARELHRRADGDTGSHGLGGQTCFSLEMEEEHLYALRWKELEMHSLALQNTLHERT 420

Query: 421   WSDEKNLMQQELRSLKQNIFLFYVKLRWLLKHWRQGKQMEEEGEEFTEGEHPETLSRLGE 480
             WSDEKNLMQQELRSLKQNIFLFYVKLRWLLKHWRQGKQMEEEGEEFTEGEHPETLSRLGE
Sbjct: 421   WSDEKNLMQQELRSLKQNIFLFYVKLRWLLKHWRQGKQMEEEGEEFTEGEHPETLSRLGE 480

Query: 481   LGVQGGHQADGPDHDSDRGCGFPVGEHSPHSRVQIGDHSLRLQTADRGQPHKQVVENQQL 540
             LGVQGGHQADGPDHDSDRGCGFPVGEHSPHSRVQIGDHSLRLQTADRGQPHKQVVENQQL
Sbjct: 481   LGVQGGHQADGPDHDSDRGCGFPVGEHSPHSRVQIGDHSLRLQTADRGQPHKQVVENQQL 540

Query: 541   FSAFKALLEDFRAELREDERARLRLQQQYASDKAAWDVEWAVLKCRLEQLEEKTENKLGE 600
             FSAFKALLEDFRAELREDERARLRLQQQYASDKAAWDVEWAVLKCRLEQLEEKTENKLGE
Sbjct: 541   FSAFKALLEDFRAELREDERARLRLQQQYASDKAAWDVEWAVLKCRLEQLEEKTENKLGE 600

Query: 601   LGSSAESKGALKKEREVHQKLLADSHSLVMDLRWQIHHSEKNWNREKVELLDRLDRDRQE 660
             LGSSAESKGALKKEREVHQKLLADSHSLVMDLRWQIHHSEKNWNREKVELLDRLDRDRQE
Sbjct: 601   LGSSAESKGALKKEREVHQKLLADSHSLVMDLRWQIHHSEKNWNREKVELLDRLDRDRQE 660

Query: 661   WERQKKEFLWRIEQLQKENSPRRGGSFLCDQKDGNVRPFPHQGSLRMPRPVAMWPCADAD 720
             WERQKKEFLWRIEQLQKENSPRRGGSFLCDQKDGNVRPFPHQGSLRMPRPVAMWPCADAD
Sbjct: 661   WERQKKEFLWRIEQLQKENSPRRGGSFLCDQKDGNVRPFPHQGSLRMPRPVAMWPCADAD 720

Query: 721   SIPFEDRPLSKLKESDRCSASENLYLDALSLDDEPEEPPAHRPEREFRNRLPEEEENHKG 780
             SIPFEDRPLSKLKESDRCSASENLYLDALSLDDEPEEPPAHRPEREFRNRLPEEEENHKG
Sbjct: 721   SIPFEDRPLSKLKESDRCSASENLYLDALSLDDEPEEPPAHRPEREFRNRLPEEEENHKG 780

Query: 781   NLQRAVSVSSMSEFQRLMDISPFLPEKGLPSTSSKEDVTPPLSPDDLKYIEEFNKSWDYT 840
             NLQRAVSVSSMSEFQRLMDISPFLPEKGLPSTSSKEDVTPPLSPDDLKYIEEFNKSWDYT
Sbjct: 781   NLQRAVSVSSMSEFQRLMDISPFLPEKGLPSTSSKEDVTPPLSPDDLKYIEEFNKSWDYT 840

Query: 841   PNRGHNGGGPDLWADRTEVGRAGHEDSTEPFPDSSWYLTTSVTMTTDTMTSPEHCQKQPL 900
             PNRGHNGGGPDLWADRTEVGRAGHEDSTEPFPDSSWYLTTSVTMTTDTMTSPEHCQKQPL
Sbjct: 841   PNRGHNGGGPDLWADRTEVGRAGHEDSTEPFPDSSWYLTTSVTMTTDTMTSPEHCQKQPL 900

Query: 901   RSHVLTEQSGLRVLHSPPAVRRVDSITAAGGEGPFPTSRARGSPGDTKGGPPEPMLSRWP 960
             RSHVLTEQSGLRVLHSPPAVRRVDSITAAGGEGPFPTSRARGSPGDTKGGPPEPMLSRWP
Sbjct: 901   RSHVLTEQSGLRVLHSPPAVRRVDSITAAGGEGPFPTSRARGSPGDTKGGPPEPMLSRWP 960

Query: 961   CTSPRHSRDYVEGARRPLDSPLCTSLGFASPLHSLEMSKNLSDDMKEVAFSVRNAICSGP 1020
             CTSPRHSRDYVEGARRPLDSPLCTSLGFASPLHSLEMSKNLSDDMKEVAFSVRNAICSGP
```

Figure 4 (continued)

```
Sbjct: 961   CTSPRHSRDYVEGARRPLDSPLCTSLGFASPLHSLEMSKNLSDDMKEVAFSVRNAICSGP 1020

Query: 1021  GELQVKDMACQTNGSRTMGTQTVQTISVGLQTEALRGSGVTSSPHKCLTPKAGGGATPVS 1080
             GELQVKDMACQTNGSRTMGTQTVQTISVGLQTEALRGSGVTSSPHKCLTPKAGGGATPVS
Sbjct: 1021  GELQVKDMACQTNGSRTMGTQTVQTISVGLQTEALRGSGVTSSPHKCLTPKAGGGATPVS 1080

Query: 1081  SPSRSLRSRQVAPAIEKVQAKFERTCCSPKYGSPKLQRKPLPKADQPNNRTSPGMAQKGY 1140
             SPSRSLRSRQVAPAIEKVQAKFERTCCSPKYGSPKLQRKPLPKADQPNNRTSPGMAQKGY
Sbjct: 1081  SPSRSLRSRQVAPAIEKVQAKFERTCCSPKYGSPKLQRKPLPKADQPNNRTSPGMAQKGY 1140

Query: 1141  SESAWARSTTTRESPVHTTINDGLSSLFNIIDHSPVVQDPFQKGLRAGSRSRSAEPRPEL 1200
             SESAWARSTTTRESPVHTTINDGLSSLFNIIDHSPVVQDPFQKGLRAGSRSRSAEPRPEL
Sbjct: 1141  SESAWARSTTTRESPVHTTINDGLSSLFNIIDHSPVVQDPFQKGLRAGSRSRSAEPRPEL 1200

Query: 1201  GPGQETGTNSRGRSPSPIGVGSEMCREEGGEGTPVKQDLSAPPGYTLTENVARILNKKLL 1260
             GPGQETGTNSRGRSPSPIGVGSEMCREEGGEGTPVKQDLSAPPGYTLTENVARILNKKLL
Sbjct: 1201  GPGQETGTNSRGRSPSPIGVGSEMCREEGGEGTPVKQDLSAPPGYTLTENVARILNKKLL 1260

Query: 1261  EHALKEERRQAAHGPPGLHSDSHSLGDTAEPGPMENQTVLLTAPWGL 1307
             EHALKEERRQAAHGPPGLHSDSHSLGDTAEPGPMENQTVLLTAPWGL
Sbjct: 1261  EHALKEERRQAAHGPPGLHSDSHSLGDTAEPGPMENQTVLLTAPWGL 1307
```

185P2C9 v.2 (SEQ ID NO 109) Alignment with human KIAA0802 protein (SEQ ID NO 110).

Score = 1999 bits (5180), Expect = 0.0
Identities = 1128/1130 (99%), Positives = 1130/1130 (99%)

```
Query: 1     MEDTRGQQEREGPGRDHAPSIPTSPFGDSLESSTELRRHLQFVEEEAELLRRSISEIEDH 60
             MEDTRGQQEREGPGRDHAPSIPTSPFGDSLESSTELRRHLQFVEEEAELLRRSISEIEDH
Sbjct: 47    MEDTRGQQEREGPGRDHAPSIPTSPFGDSLESSTELRRHLQFVEEEAELLRRSISEIEDH 106

Query: 61    NRQLTHELSKFKFEPPREPGWLGEGASPGAGGGAPLQEELKSARLQISELSGKVLKLQHE 120
             NRQLTHELSKFKFEPPREPGWLGEGASPGAGGGAPLQEELKSARLQISELSGKVLKLQHE
Sbjct: 107   NRQLTHELSKFKFEPPREPGWLGEGASPGAGGGAPLQEELKSARLQISELSGKVLKLQHE 166

Query: 121   NHALLSNIQRCDLAAHLGLRAPSPRDSDAESDAGKKESDGEESRLPQPKREGPVGGESDS 180
             NHALLSNIQRCDLAAHLGLRAPSPRDSDAESDAGKKESDGEESRLPQPKREGPVGGESDS
Sbjct: 167   NHALLSNIQRCDLAAHLGLRAPSPRDSDAESDAGKKESDGEESRLPQPKREGPVGGESDS 226

Query: 181   EEMFEKTSGFGSGKPSEASEPCPTELLKAREDSEYLVTLKHEAQRLERTVERLITDTDSF 240
             EEMFEKTSGFGSGKPSEASEPCPTELLKAREDSEYLVTLKHEAQRLERTVERLITDTDSF
Sbjct: 227   EEMFEKTSGFGSGKPSEASEPCPTELLKAREDSEYLVTLKHEAQRLERTVERLITDTDSF 286

Query: 241   LHDAGLRGGAPLPGPGLQGEEEQGEGDQQEPQLLGTINAKMKAFKKELQAFLQQVNRIGD 300
```

Figure 4 (continued)

```
            LHDAGLRGGAPLPGPGLQGEEEQGEGDQQEPQLLGTINAKMKAFKKELQAFL+QVNRIGD
Sbjct: 287  LHDAGLRGGAPLPGPGLQGEEEQGEGDQQEPQLLGTINAKMKAFKKELQAFLEQVNRIGD 346

Query: 301  GLSPLPHLTESSSFLSTVTSVSRDSPIGNLGKELGPDLQSRLKEQLEWQLGPAQGDERES 360
            GLSPLPHLTESSSFLSTVTSVSRDSPIGNLGKELGPDLQSRLKEQLEWQLGPA+GDERES
Sbjct: 347  GLSPLPHLTESSSFLSTVTSVSRDSPIGNLGKELGPDLQSRLKEQLEWQLGPARGDERES 406

Query: 361  LRLRAARELHRRADGDTGSHGLGGQTCFSLEMEEEHLYALRWKELEMHSLALQNTLHERT 420
            LRLRAARELHRRADGDTGSHGLGGQTCFSLEMEEEHLYALRWKELEMHSLALQNTLHERT
Sbjct: 407  LRLRAARELHRRADGDTGSHGLGGQTCFSLEMEEEHLYALRWKELEMHSLALQNTLHERT 466

Query: 421  WSDEKNLMQQELRSLKQNIFLFYVKLRWLLKHWRQGKQMEEEGEEFTEGEHPETLSRLGE 480
            WSDEKNLMQQELRSLKQNIFLFYVKLRWLLKHWRQGKQMEEEGEEFTEGEHPETLSRLGE
Sbjct: 467  WSDEKNLMQQELRSLKQNIFLFYVKLRWLLKHWRQGKQMEEEGEEFTEGEHPETLSRLGE 526

Query: 481  LGVQGGHQADGPDHDSDRGCGFPVGEHSPHSRVQIGDHSLRLQTADRGQPHKQVVENQQL 540
            LGVQGGHQADGPDHDSDRGCGFPVGEHSPHSRVQIGDHSLRLQTADRGQPHKQVVENQQL
Sbjct: 527  LGVQGGHQADGPDHDSDRGCGFPVGEHSPHSRVQIGDHSLRLQTADRGQPHKQVVENQQL 586

Query: 541  FSAFKALLEDFRAELREDERARLRLQQQYASDKAAWDVEWAVLKCRLEQLEEKTENKLGE 600
            FSAFKALLEDFRAELREDERARLRLQQQYASDKAAWDVEWAVLKCRLEQLEEKTENKLGE
Sbjct: 587  FSAFKALLEDFRAELREDERARLRLQQQYASDKAAWDVEWAVLKCRLEQLEEKTENKLGE 646

Query: 601  LGSSAESKGALKKEREVHQKLLADSHSLVMDLRWQIHHSEKNWNREKVELLDRLDRDRQE 660
            LGSSAESKGALKKEREVHQKLLADSHSLVMDLRWQIHHSEKNWNREKVELLDRLDRDRQE
Sbjct: 647  LGSSAESKGALKKEREVHQKLLADSHSLVMDLRWQIHHSEKNWNREKVELLDRLDRDRQE 706

Query: 661  WERQKKEFLWRIEQLQKENSPRRGGSFLCDQKDGNVRPFPHQGSLRMPRPVAMWPCADAD 720
            WERQKKEFLWRIEQLQKENSPRRGGSFLCDQKDGNVRPFPHQGSLRMPRPVAMWPCADAD
Sbjct: 707  WERQKKEFLWRIEQLQKENSPRRGGSFLCDQKDGNVRPFPHQGSLRMPRPVAMWPCADAD 766

Query: 721  SIPFEDRPLSKLKESDRCSASENLYLDALSLDDEPEEPPAHRPEREFRNRLPEEEENHKG 780
            SIPFEDRPLSKLKESDRCSASENLYLDALSLDDEPEEPPAHRPEREFRNRLPEEEENHKG
Sbjct: 767  SIPFEDRPLSKLKESDRCSASENLYLDALSLDDEPEEPPAHRPEREFRNRLPEEEENHKG 826

Query: 781  NLQRAVSVSSMSEFQRLMDISPFLPEKGLPSTSSKEDVTPPLSPDDLKYIEEFNKSWDYT 840
            NLQRAVSVSSMSEFQRLMDISPFLPEKGLPSTSSKEDVTPPLSPDDLKYIEEFNKSWDYT
Sbjct: 827  NLQRAVSVSSMSEFQRLMDISPFLPEKGLPSTSSKEDVTPPLSPDDLKYIEEFNKSWDYT 886

Query: 841  PNRGHNGGGPDLWADRTEVGRAGHEDSTEPFPDSSWYLTTSVTMTTDTMTSPEHCQKQPL 900
            PNRGHNGGGPDLWADRTEVGRAGHEDSTEPFPDSSWYLTTSVTMTTDTMTSPEHCQKQPL
Sbjct: 887  PNRGHNGGGPDLWADRTEVGRAGHEDSTEPFPDSSWYLTTSVTMTTDTMTSPEHCQKQPL 946

Query: 901  RSHVLTEQSGLRVLHSPPAVRRVDSITAAGGEGPFPTSRARGSPGDTKGGPPEPMLSRWP 960
            RSHVLTEQSGLRVLHSPPAVRRVDSITAAGGEGPFPTSRARGSPGDTKGGPPEPMLSRWP
```

Figure 4 (continued)

```
Sbjct: 947  RSHVLTEQSGLRVLHSPPAVRRVDSITAAGGEGPFPTSRARGSPGDTKGGPPEPMLSRWP 1006

Query: 961  CTSPRHSRDYVEGARRPLDSPLCTSLGFASPLHSLEMSKNLSDDMKEVAFSVRNAICSGP 1020

            CTSPRHSRDYVEGARRPLDSPLCTSLGFASPLHSLEMSKNLSDDMKEVAFSVRNAICSGP
Sbjct: 1007 CTSPRHSRDYVEGARRPLDSPLCTSLGFASPLHSLEMSKNLSDDMKEVAFSVRNAICSGP 1066

Query: 1021 GELQVKDMACQTNGSRTMGTQTVQTISVGLQTEALRGSGVTSSPHKCLTPKAGGGATPVS 1080
            GELQVKDMACQTNGSRTMGTQTVQTISVGLQTEALRGSGVTSSPHKCLTPKAGGGATPVS
Sbjct: 1067 GELQVKDMACQTNGSRTMGTQTVQTISVGLQTEALRGSGVTSSPHKCLTPKAGGGATPVS 1126

Query: 1081 SPSRSLRSRQVAPAIEKVQAKFERTCCSPKYGSPKLQRKPLPKADQPNNR 1130
            SPSRSLRSRQVAPAIEKVQAKFERTCCSPKYGSPKLQRKPLPKADQPNNR
Sbjct: 1127 SPSRSLRSRQVAPAIEKVQAKFERTCCSPKYGSPKLQRKPLPKADQPNNR 1176
```

185P2C9 v.3 (same gene as above)

159P2B5 (SEQ ID NO 111) Alignment with hypothetical protein XP_040796 (SEQ ID NO 112).
Score = 348 bits (893), Expect = 2e-95
Identities = 224/224 (100%), Positives = 224/224 (100%)

```
Query: 1    MVKREHGQERPTFWGWAATPAPVSAPGNPPTGEGERQGSPPGGGFLGSTSFQRRGEKELL 60
            MVKREHGQERPTFWGWAATPAPVSAPGNPPTGEGERQGSPPGGGFLGSTSFQRRGEKELL
Sbjct: 1    MVKREHGQERPTFWGWAATPAPVSAPGNPPTGEGERQGSPPGGGFLGSTSFQRRGEKELL 60

Query: 61   WERGQDVSRSVLAMRAILPPSLSKSVHFPPLPHSCTLVALLSLGLQDPLGCRAPATKPTP 120
            WERGQDVSRSVLAMRAILPPSLSKSVHFPPLPHSCTLVALLSLGLQDPLGCRAPATKPTP
Sbjct: 61   WERGQDVSRSVLAMRAILPPSLSKSVHFPPLPHSCTLVALLSLGLQDPLGCRAPATKPTP 120

Query: 121  AGATLSASSLPRPCSPSASLLLSWPLFWGILGGVFFLGSRACTRTQARRHTGPAAALLRL 180
            AGATLSASSLPRPCSPSASLLLSWPLFWGILGGVFFLGSRACTRTQARRHTGPAAALLRL
Sbjct: 121  AGATLSASSLPRPCSPSASLLLSWPLFWGILGGVFFLGSRACTRTQARRHTGPAAALLRL 180

Query: 181  LFPAPRRPGARSRAGYASPGSPERRSPGTAHKGSLPWPLALRLL 224
            LFPAPRRPGARSRAGYASPGSPERRSPGTAHKGSLPWPLALRLL
Sbjct: 181  LFPAPRRPGARSRAGYASPGSPERRSPGTAHKGSLPWPLALRLL 224
```

184P3G10 (SEQ ID NO 113) Alignment with human hypothetical protein XP_092661 (SEQ ID NO 114).

Score = 1318 bits (3410), Expect = 0.0
Identities = 700/717 (97%), Positives = 701/717 (97%), Gaps = 16/717 (2%)

Figure 4 (continued)

```
Query: 32   MTSQPLRLAEEYGPSPGESELAVNPFDGLPFSSRYYELLKQRQALPIWAARFTFLEQLES 91
            MTSQPLRLAEEYGPSPGESELAVNPFDGLPFSSRYYELLKQRQALPIWAARFTFLEQLES
Sbjct: 1    MTSQPLRLAEEYGPSPGESELAVNPFDGLPFSSRYYELLKQRQALPIWAARFTFLEQLES 60

Query: 92   NPTGVVLVSGEPGSGKSTQIPQWCAEFALARGFQKGQVTVTQPYPLAARSLALRVADEMD 151
            NPTGVVLVSGEPGSGKSTQIPQWCAEFALARGFQKGQVTVTQPYPLAARSLALRVADEMD
Sbjct: 61   NPTGVVLVSGEPGSGKSTQIPQWCAEFALARGFQKGQVTVTQPYPLAARSLALRVADEMD 120

Query: 152  LTLGHEVGYSIPQEDCTGPNTLLRFCWDRLLLQEVASTRGTGAWGVLVLDEAQERSVASD 211
            LTLGHEVGYSIPQEDCTGPNTLLRFCWDRLLLQEVASTRGTGAWGVLVLDEAQERSVASD
Sbjct: 121  LTLGHEVGYSIPQEDCTGPNTLLRFCWDRLLLQEVASTRGTGAWGVLVLDEAQERSVASD 180

Query: 212  SLQGLLQDARLEKLPGDLRVVVVTDPALEPKLRAFWGNPPIVHIPREPGERPSPIYWDTI 271
            SLQGLLQDARLEKLPGDLRVVVVTDPALEPKLRAFWGNPPIVHIPREPGERPSPIYWDTI
Sbjct: 181  SLQGLLQDARLEKLPGDLRVVVVTDPALEPKLRAFWGNPPIVHIPREPGERPSPIYWDTI 240

Query: 272  PPDRVEAACQAVLELCRKELPGDVLVFLPSEEEISLCCESLSREVESLLLQGLPPRVLPL 331
            PPDRVEAACQAVLELCRKELPGDVLVFLPSEEEISLCCESLSREVESLLLQGLPPRVLPL
Sbjct: 241  PPDRVEAACQAVLELCRKELPGDVLVFLPSEEEISLCCESLSREVESLLLQGLPPRVLPL 300

Query: 332  HPDCGRAVQAVYEDMDARKVVVTHWLADFSFSLPSIQHVIDSGLELRSVYNPRIRAEFQV 391
            HPDCGRAVQAVYEDMDARKVVVTHWLADFSFSLPSIQHVIDSGLELRSVYNPRIRAEFQV
Sbjct: 301  HPDCGRAVQAVYEDMDARKVVVTHWLADFSFSLPSIQHVIDSGLELRSVYNPRIRAEFQV 360

Query: 392  LRPISKCQAEARRLRARGFPPGSCLCLYPKSFLELEAPPLPQPRVCEENLSSLVLLLKRR 451
            LRPISKCQAEARRLRARGFPPGSCLCLYPKSFLELEAPPLPQPRVCEENLSSLVLLLKRR
Sbjct: 361  LRPISKCQAEARRLRARGFPPGSCLCLYPKSFLELEAPPLPQPRVCEENLSSLVLLLKRR 420

Query: 452  QIAEPGECHFLDQPAPEALMQALEDLDYLAALDDDGDLSDLGVILSEFPLAPELAKALLA 511
            QIAEPGECHFLDQPAPEALMQALEDLDYLAALDDDGDLSDLGVILSEFPLAPELAKALLA
Sbjct: 421  QIAEPGECHFLDQPAPEALMQALEDLDYLAALDDDGDLSDLGVILSEFPLAPELAKALLA 480

Query: 512  SCEFDCVDEMLTLAAMLTAAPGFTRPPLSAEEAALRRALEHTDGDHSSLIQVYEAFIQSG 571
            SCEFDCVDEMLTLAAMLTAAPGFTRPPLSAEEAALRRALEHTDGDHSSLIQVYEAFIQSG
Sbjct: 481  SCEFDCVDEMLTLAAMLTAAPGFTRPPLSAEEAALRRALEHTDGDHSSLIQVYEAFIQSG 540

Query: 572  ADEAWCQARGLNWAALCQAHKLRGELLELMQRIELPLSLPAFGSEQNRRDLQKALVSGYF 631
            ADEAWCQARGLNWAALCQAHKLRGELLELMQRIELPLSLPAFGSEQNRRDLQKALVSGYF
Sbjct: 541  ADEAWCQARGLNWAALCQAHKLRGELLELMQRIELPLSLPAFGSEQNRRDLQKALVSGYF 600

Query: 632  LKVARDTDGTGNYLLLTHKHVAQLSSYCCYRSRRAPARPPPWVLYHNFTISKDNCLSIVS 691
            LKVARDTDGTGNYLLLTHKHVAQLSSYCCYRSRRAPARPPPWVLYHNFTISKDNCLSIVS
Sbjct: 601  LKVARDTDGTGNYLLLTHKHVAQLSSYCCYRSRRAPARPPPWVLYHNFTISKDNCLSIVS 660

Query: 692  EIQPQMLVELAPPYFLSNLPPSESRDLLNQLREGMADSTAGSKSSSAQEFRDPCVLQ 748
```

Figure 4 (continued)

```
            EIQPQ+                ESRDLLNQLREGMADSTAGSKSSSAQEFRDPCVLQ
Sbjct: 661 EIQPQI----------------ESRDLLNQLREGMADSTAGSKSSSAQEFRDPCVLQ 701
```

Figure 5A: 74P3B3 variant 1a Hydrophilicity profile
(Hopp T.P., Woods K.R., 1981. Proc. Natl. Acad. Sci. U.S.A. 78:3824-3828)
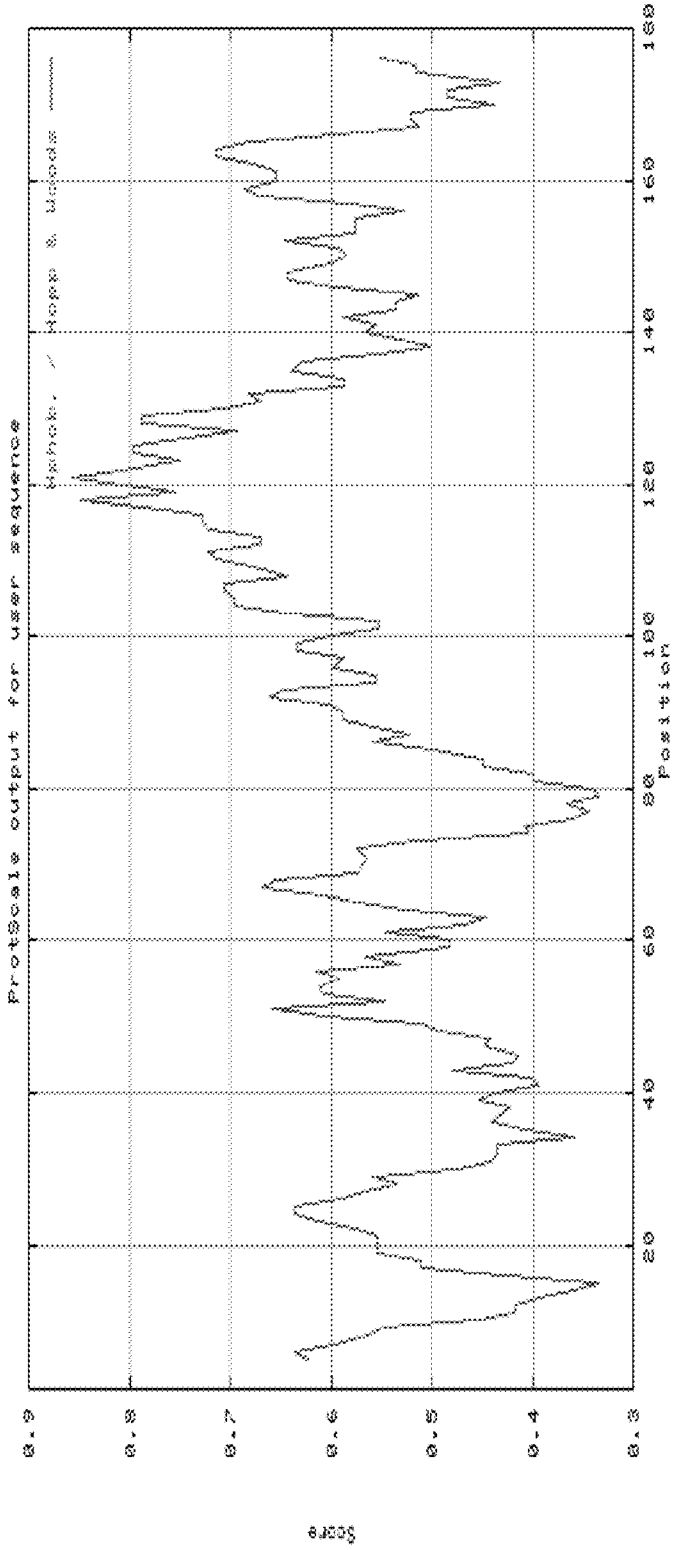

74P3B3 variant 1b Hydrophilicity profile
(Hopp T.P., Woods K.R., 1981. Proc. Natl. Acad. Sci. U.S.A. 78:3824-3828)

83P4B8 Hydrophilicity profile
(Hopp T.P., Woods K.R., 1981. Proc. Natl. Acad. Sci. U.S.A. 78:3824-3828)

109P1D4 Hydrophilicity profile
(Hopp T.P., Woods K.R., 1981. Proc. Natl. Acad. Sci. U.S.A. 78:3824-3828)

Figure 5E: 151P4E11 Hydrophilicity profile
(Hopp T.P., Woods K.R., 1981. Proc. Natl. Acad. Sci. U.S.A. 78:3824-3828)
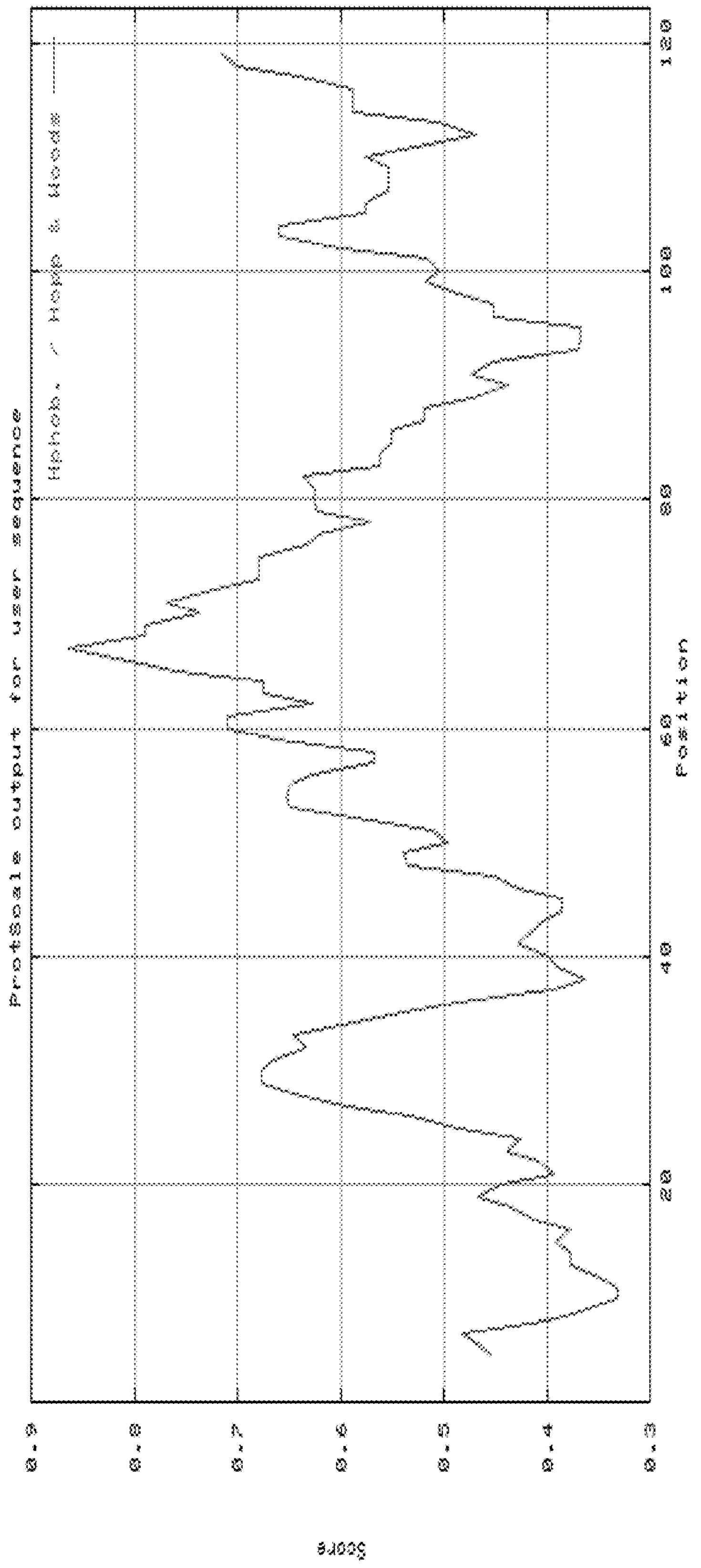

Figure 5F: 151P1C7a Hydrophilicity profile
(Hopp T.P., Woods K.R., 1981. Proc. Natl. Acad. Sci. U.S.A. 78:3824-3828)
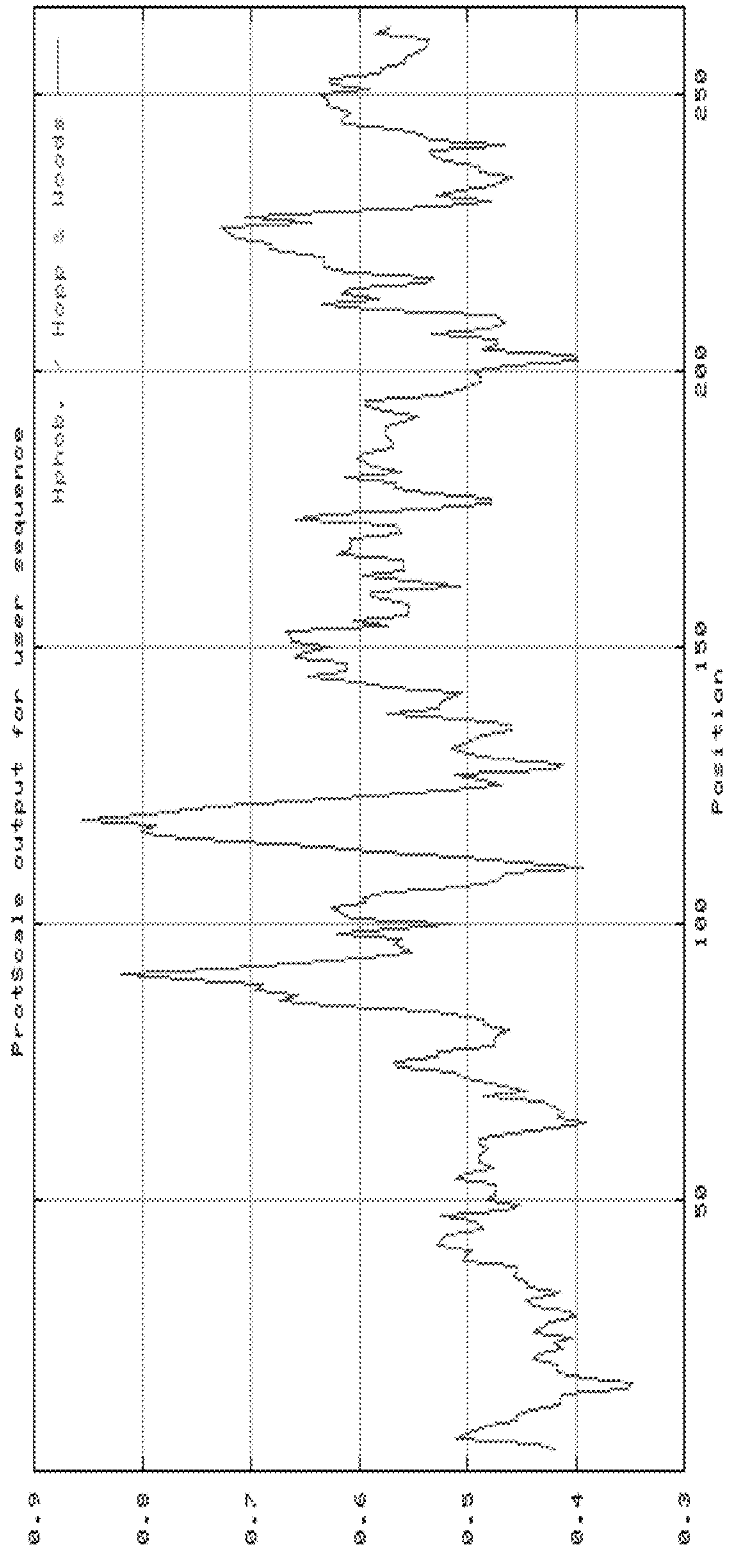

Figure 5G: 154P2A8 Hydrophilicity profile
(Hopp T.P., Woods K.R., 1981. Proc. Natl. Acad. Sci. U.S.A. 78:3824-3828)
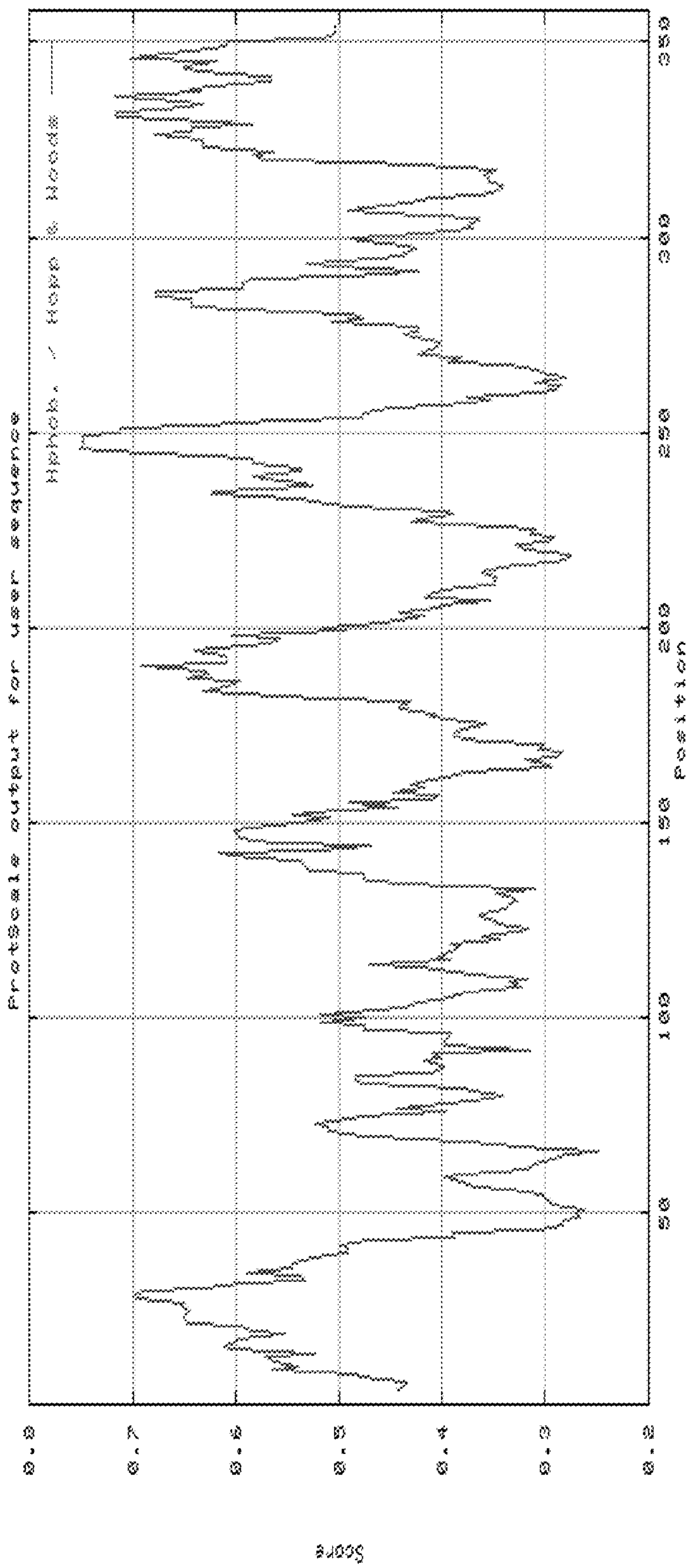

Figure 5H: 156P1D4 Hydrophilicity profile
(Hopp T.P., Woods K.R., 1981. Proc. Natl. Acad. Sci. U.S.A. 78:3824-3828)
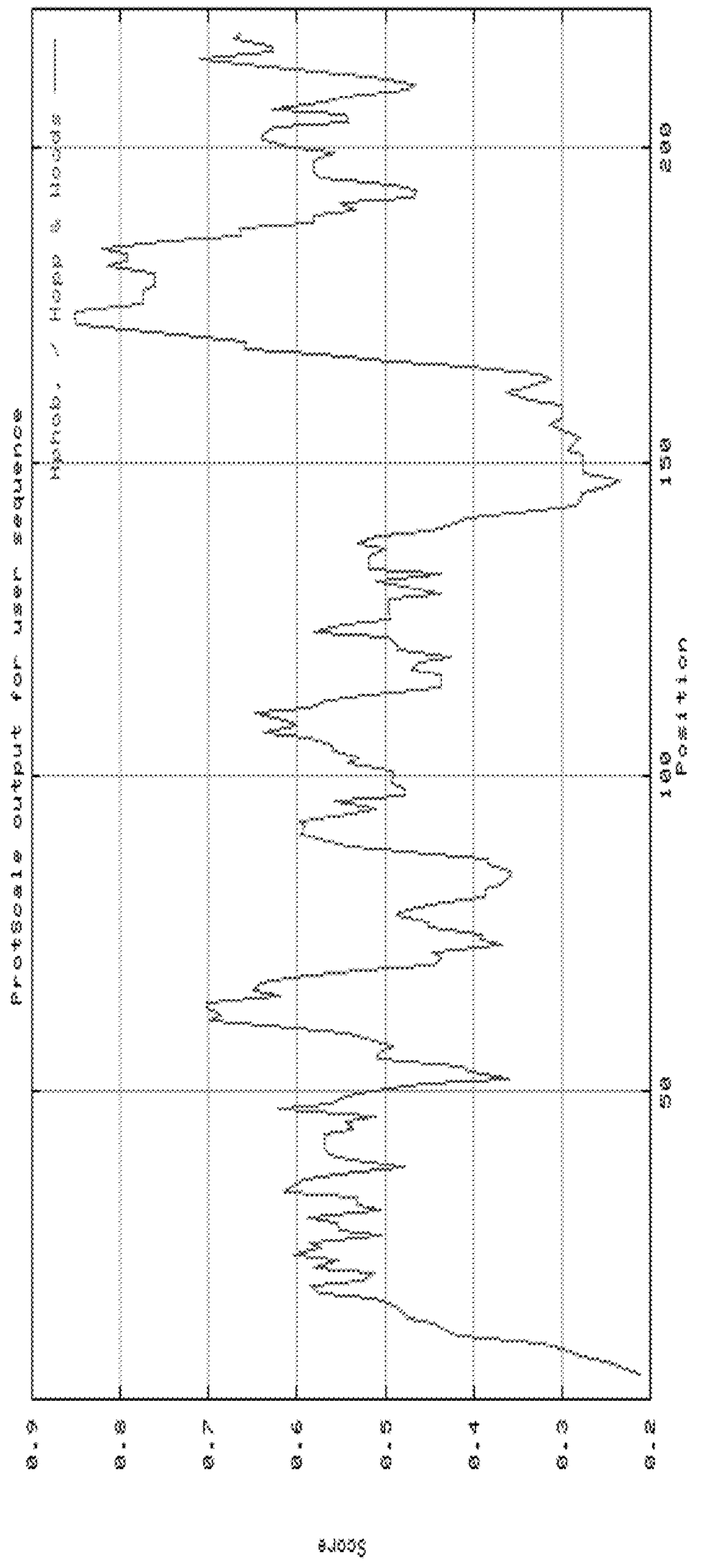

Figure 5I: 156P5C12 Hydrophilicity profile
(Hopp T.P., Woods K.R., 1981. Proc. Natl. Acad. Sci. U.S.A. 78:3824-3828)
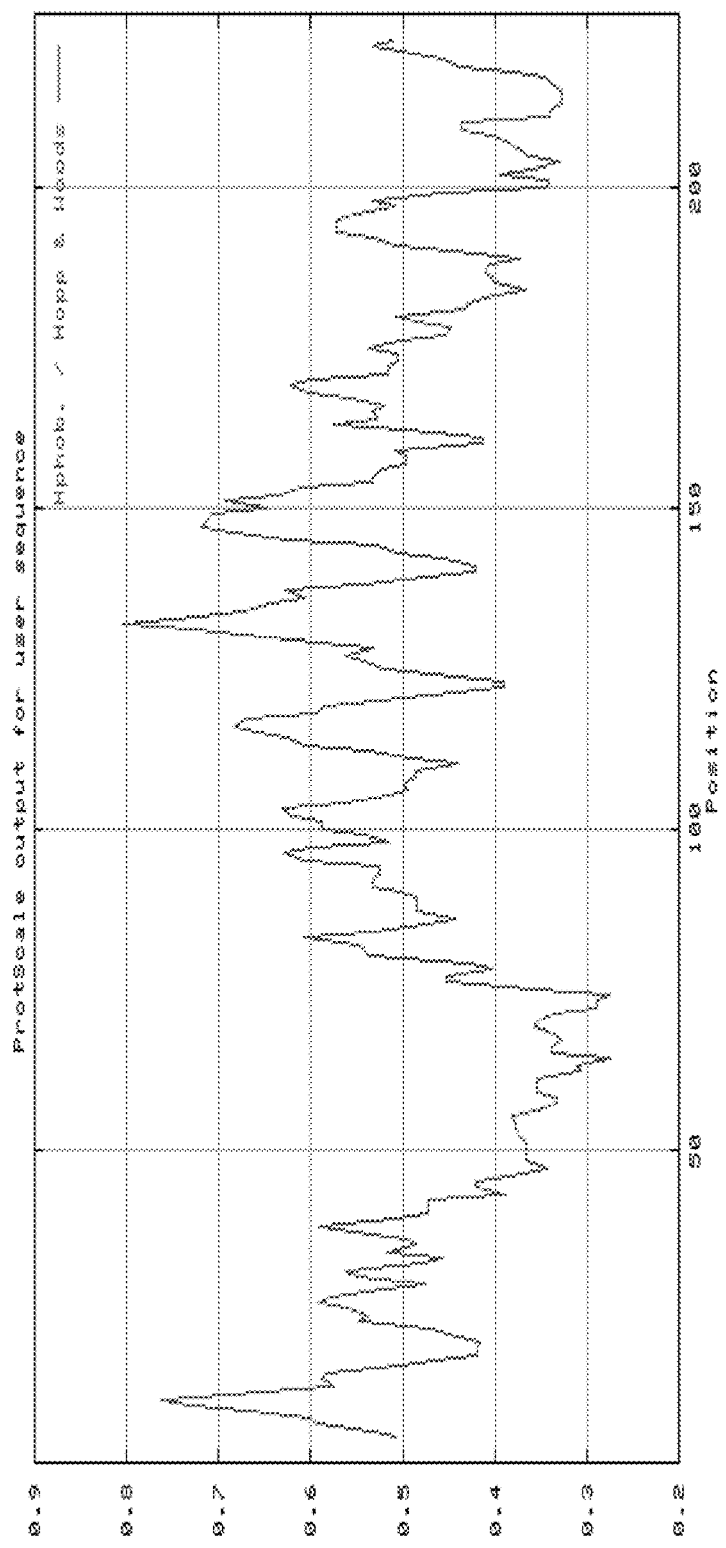

Figure 5J: 159P2B5 Hydrophilicity profile
(Hopp T.P., Woods K.R., 1981. Proc. Natl. Acad. Sci. U.S.A. 78:3824-3828)
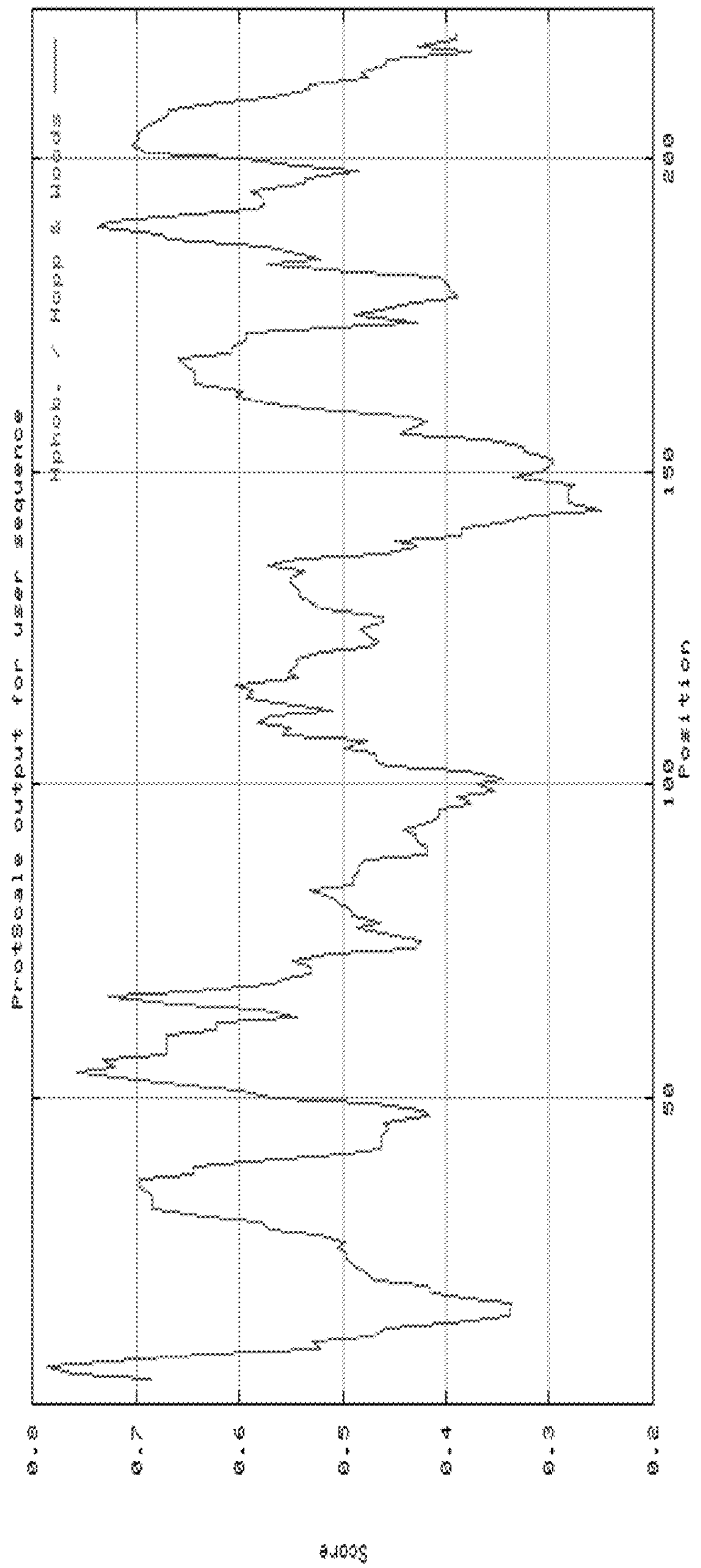

Figure 5K: 161P2B7a Hydrophilicity profile
(Hopp T.P., Woods K.R., 1981. Proc. Natl. Acad. Sci. U.S.A. 78:3824-3828)
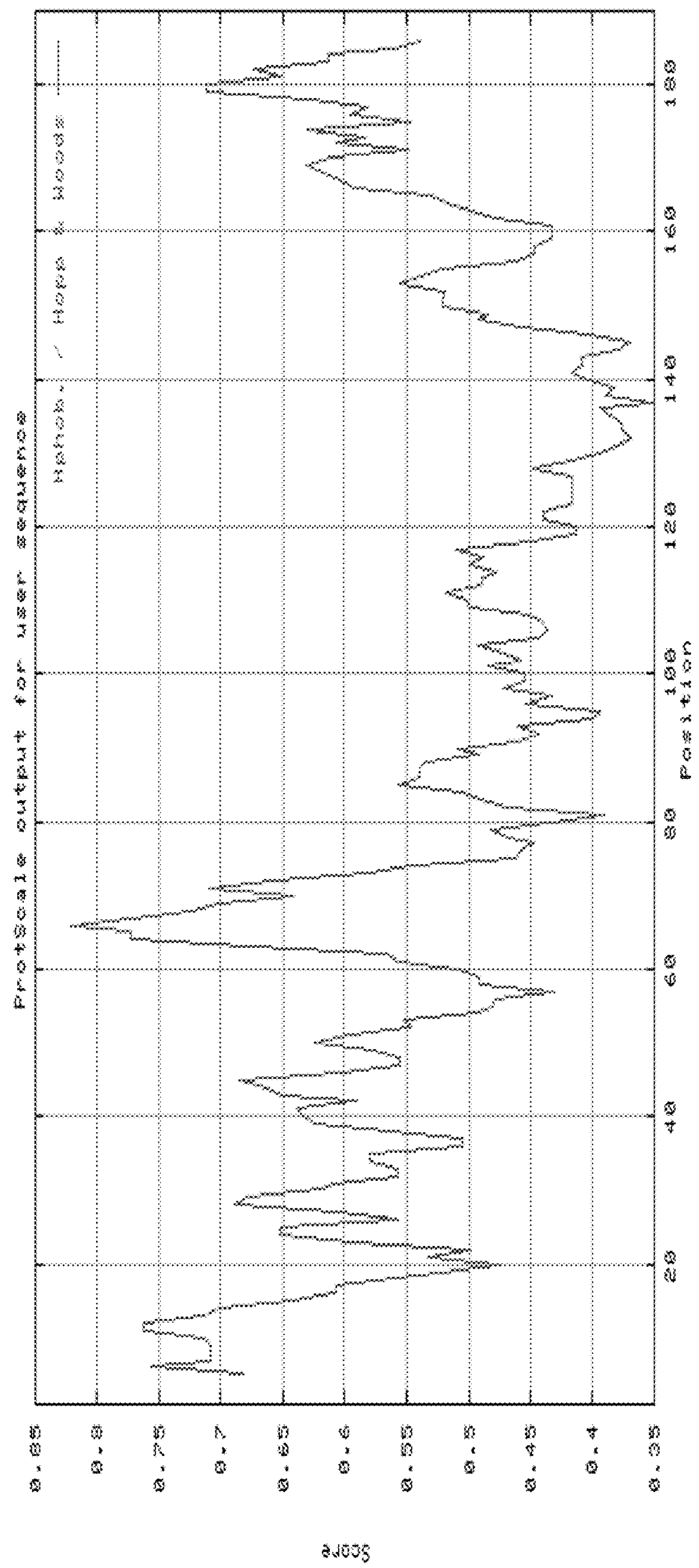

Figure 5L: 179P3G7 Hydrophilicity profile
(Hopp T.P., Woods K.R., 1981. Proc. Natl. Acad. Sci. U.S.A. 78:3824-3828)
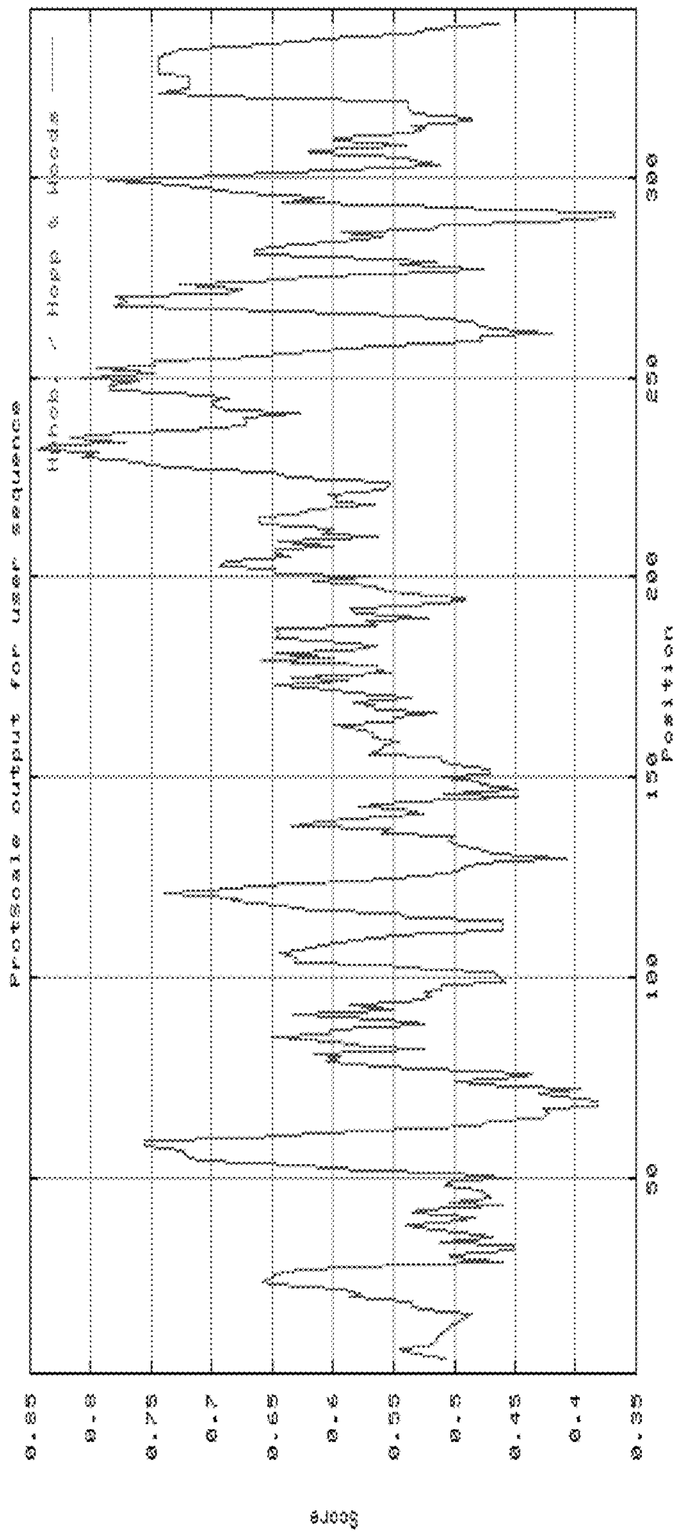

Figure 5M: 184P3C10b Hydrophilicity profile
(Hopp T.P., Woods K.R., 1981, Proc. Natl. Acad. Sci. U.S.A. 78:3824-3828)
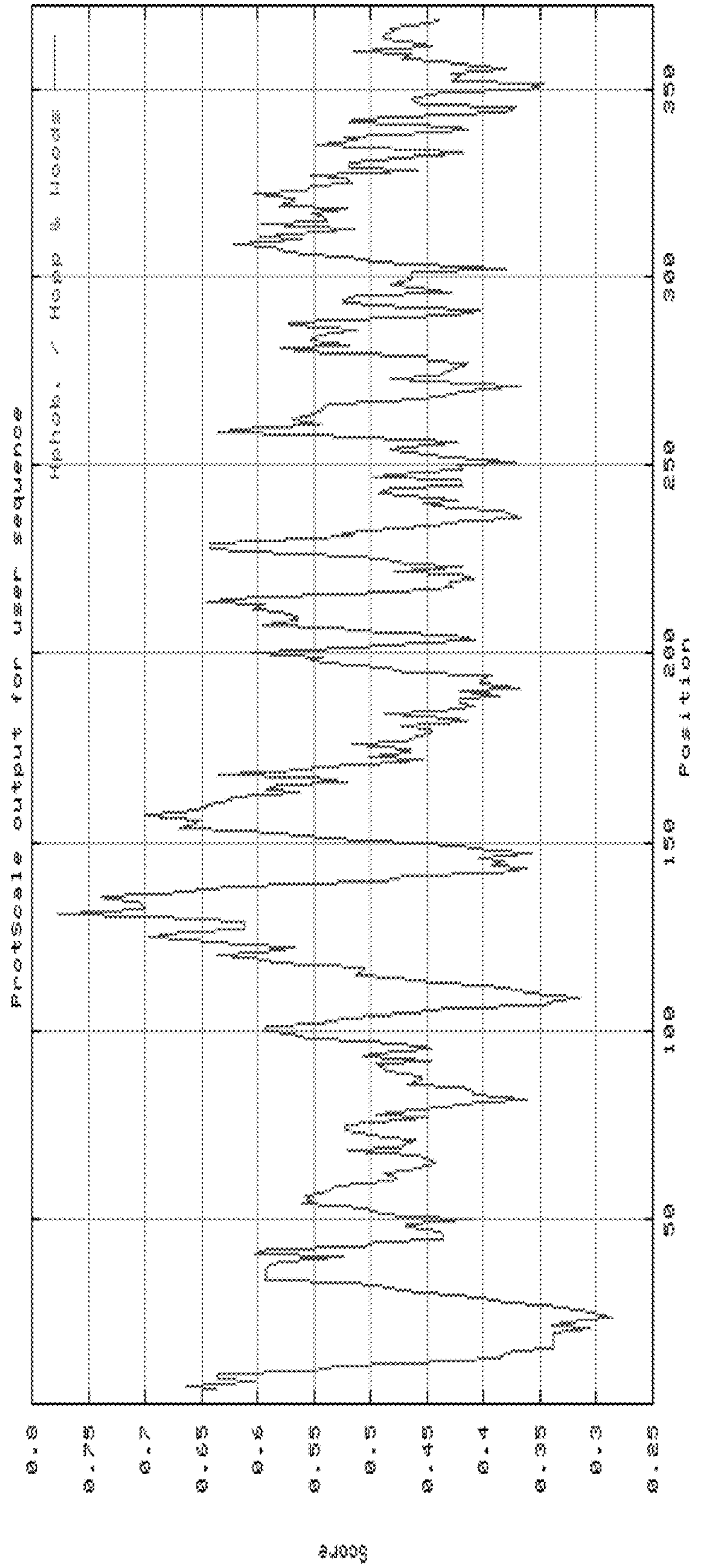

Figure 5N: 184P3G10 Hydrophilicity profile
(Hopp T.P., Woods K.R., 1981. Proc. Natl. Acad. Sci. U.S.A. 78:3824-3828)
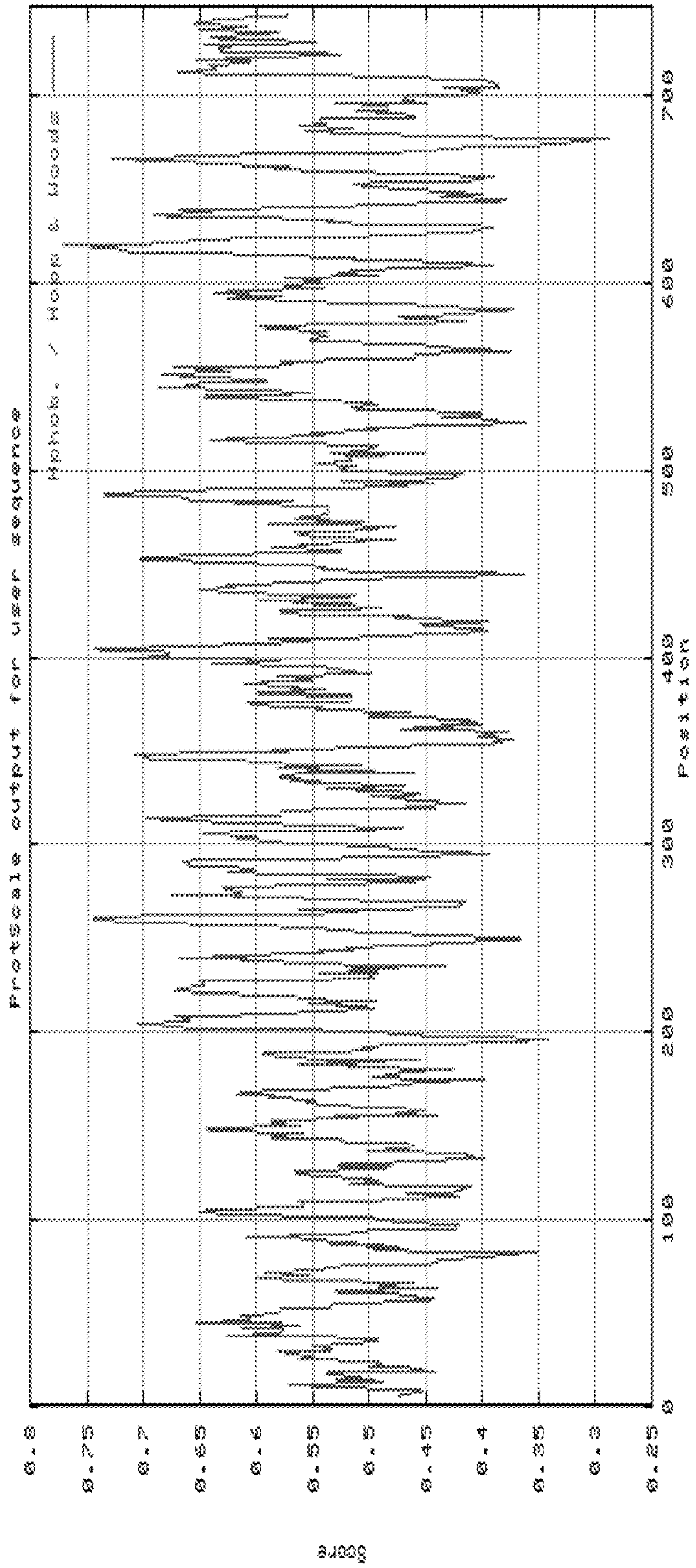

Figure 5O: 185P2C9 variant 1 Hydrophilicity profile
(Hopp T.P., Woods K.R., 1981. Proc. Natl. Acad. Sci. U.S.A. 78:3824-3828)
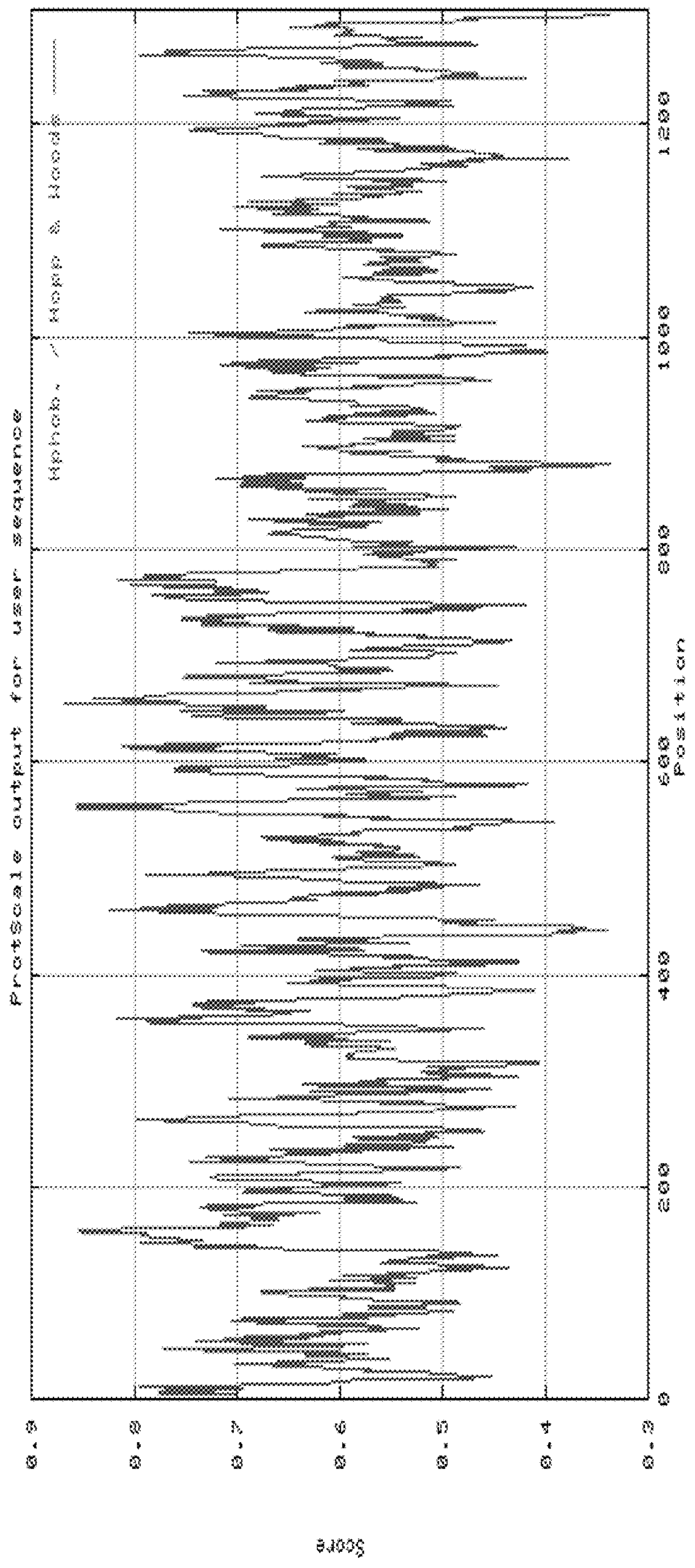

Figure 5P: 185P2C9 variant 2 Hydrophilicity profile
(Hopp T.P., Woods K.R., 1981. Proc. Natl. Acad. Sci. U.S.A. 78:3824-3828)
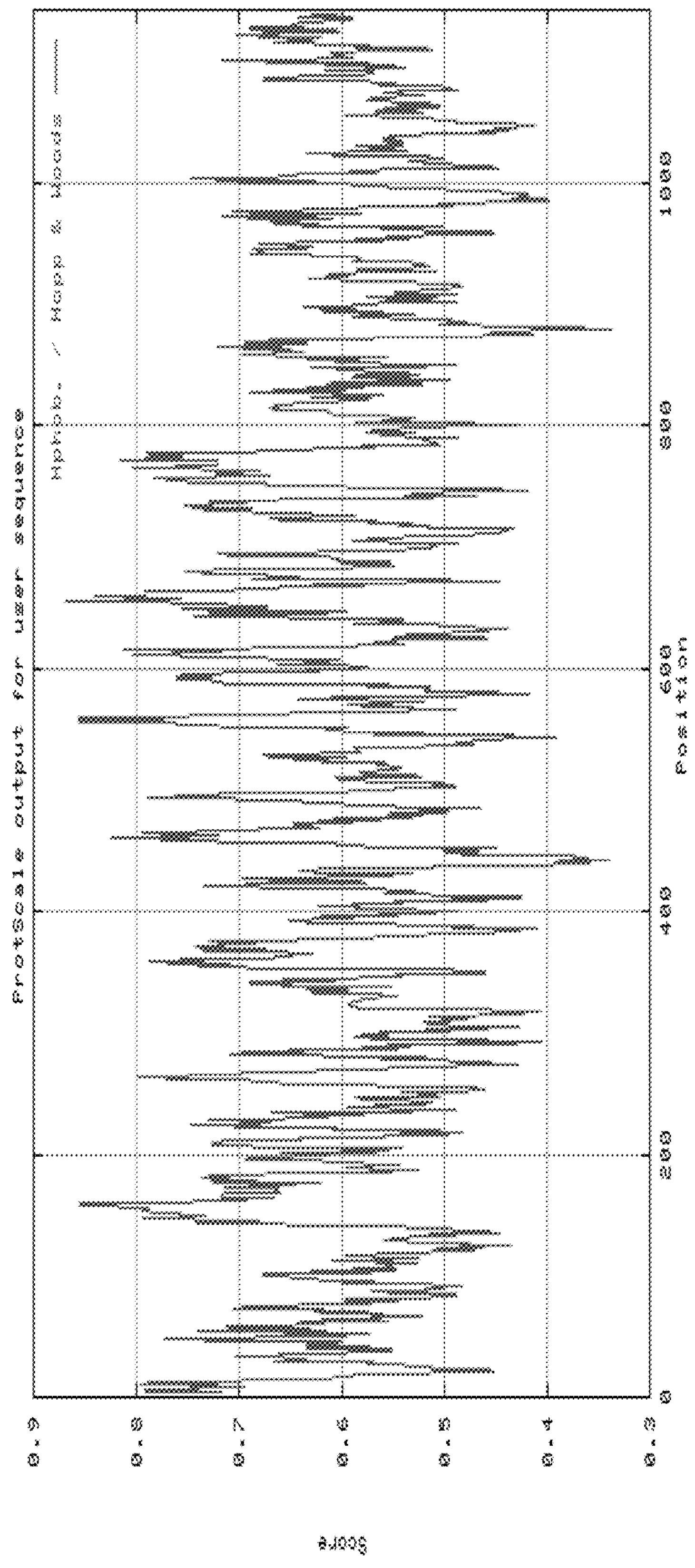

Figure 5Q: 185P2C9 variant 3 Hydrophilicity profile
(Hopp T.P., Woods K.R., 1981, Proc. Natl. Acad. Sci. U.S.A. 78:3824-3828)
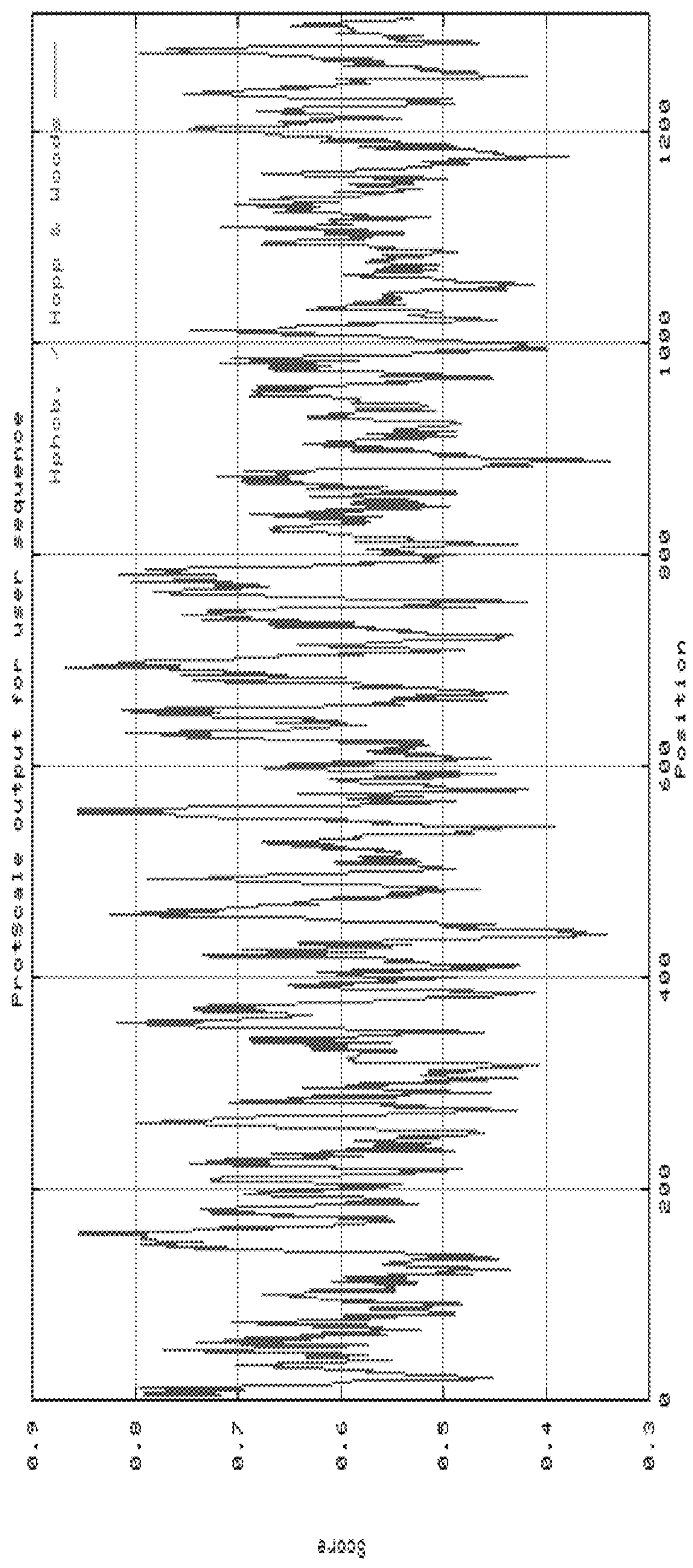

Figure 5R: 185P3C2 Hydrophilicity profile
(Hopp T.P., Woods K.R., 1981. Proc. Natl. Acad. Sci. U.S.A. 78:3824-3828)
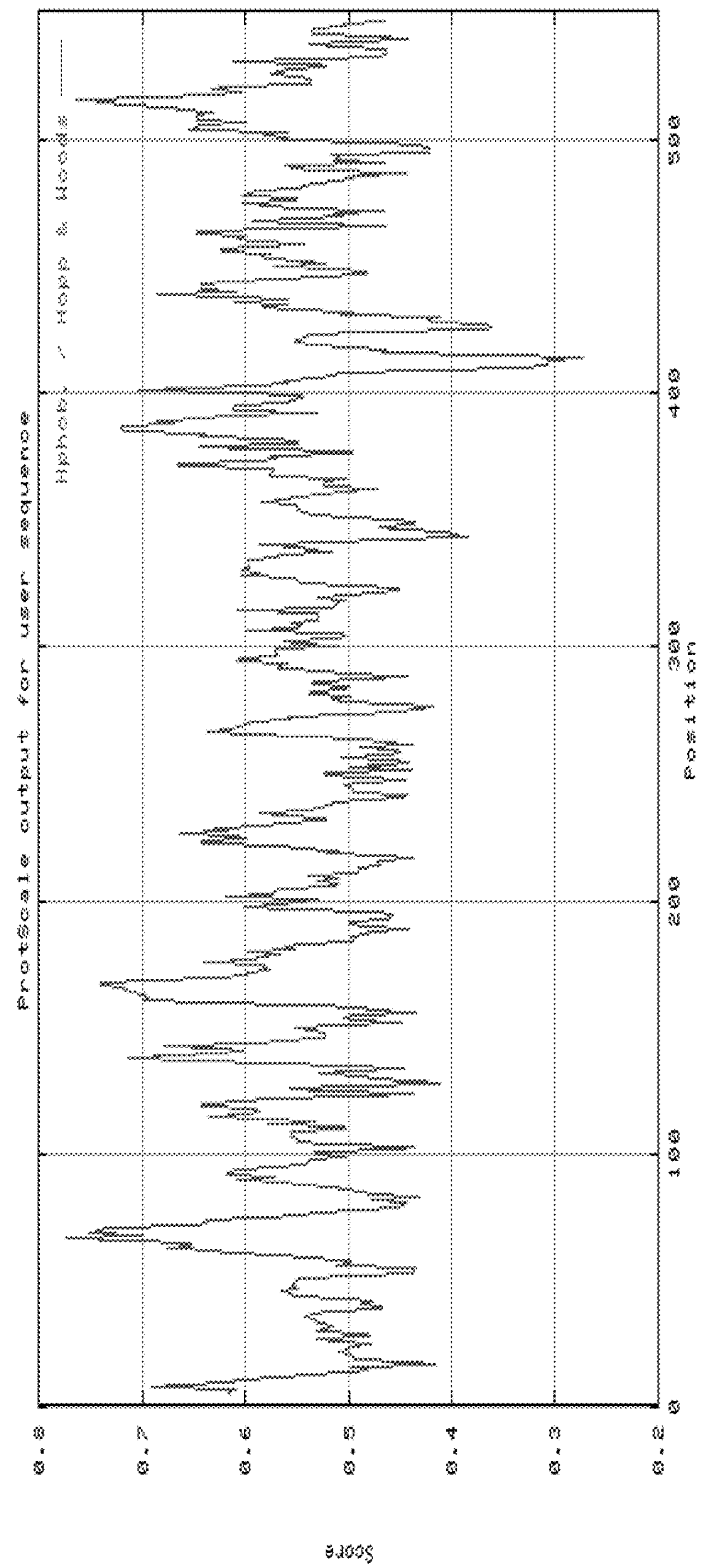

Figure 5S: 186P1H9 Hydrophilicity profile
(Hopp T.P., Woods K.R., 1981. Proc. Natl. Acad. Sci. U.S.A. 78:3824-3828)
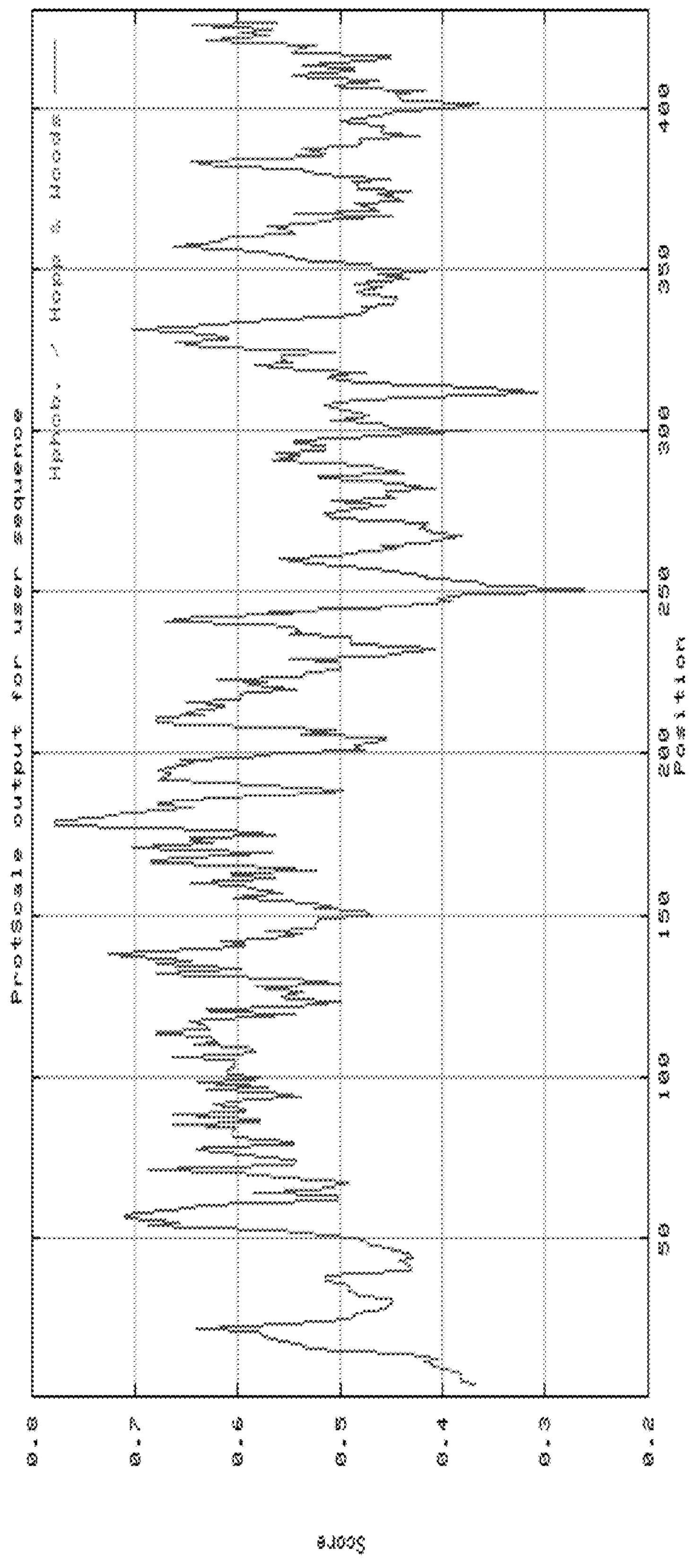

Figure 5T: 187P3F2 Hydrophilicity profile
(Hopp T.P., Woods K.R., 1981. Proc. Natl. Acad. Sci. U.S.A. 78:3824-3828)
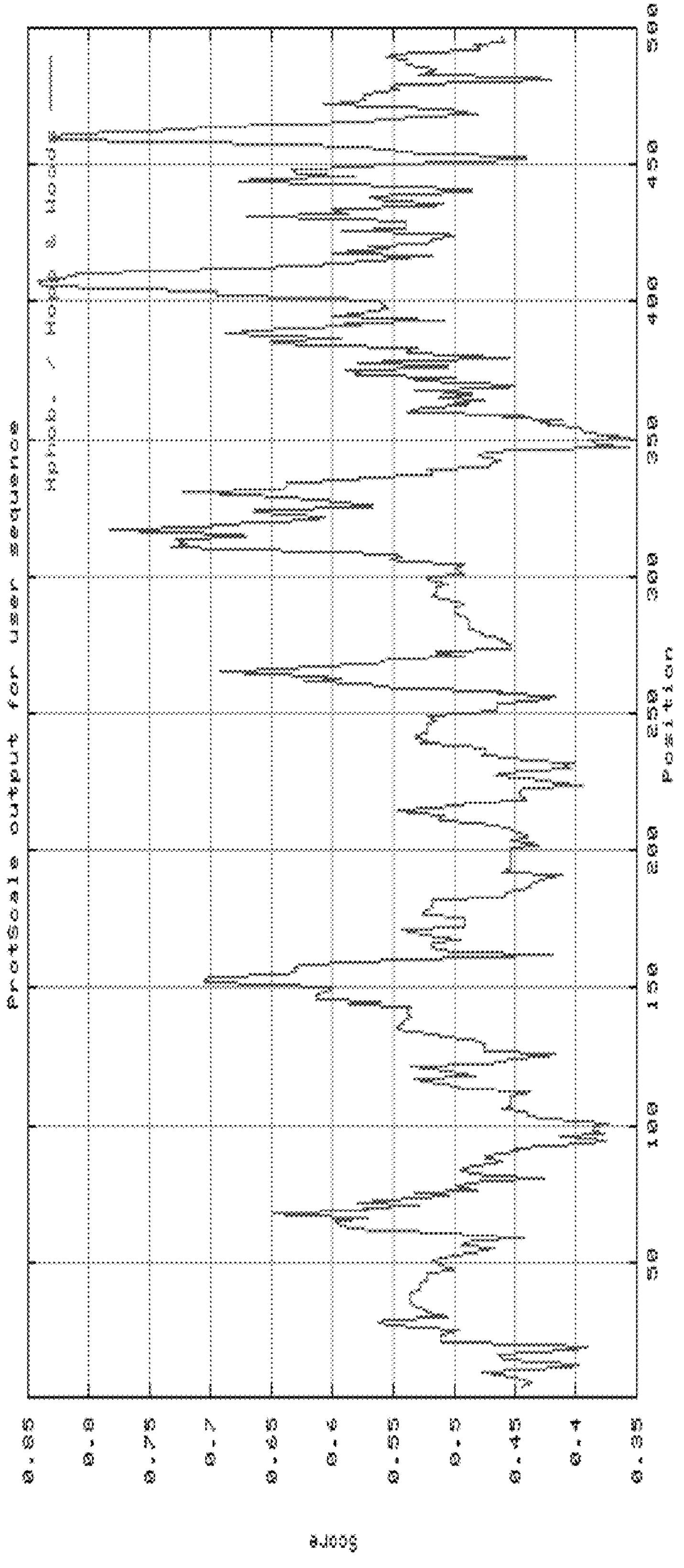

Figure 5U: 192P2G7 Hydrophilicity profile
(Hopp T.P., Woods K.R., 1981. Proc. Natl. Acad. Sci. U.S.A. 78:3824-3828)
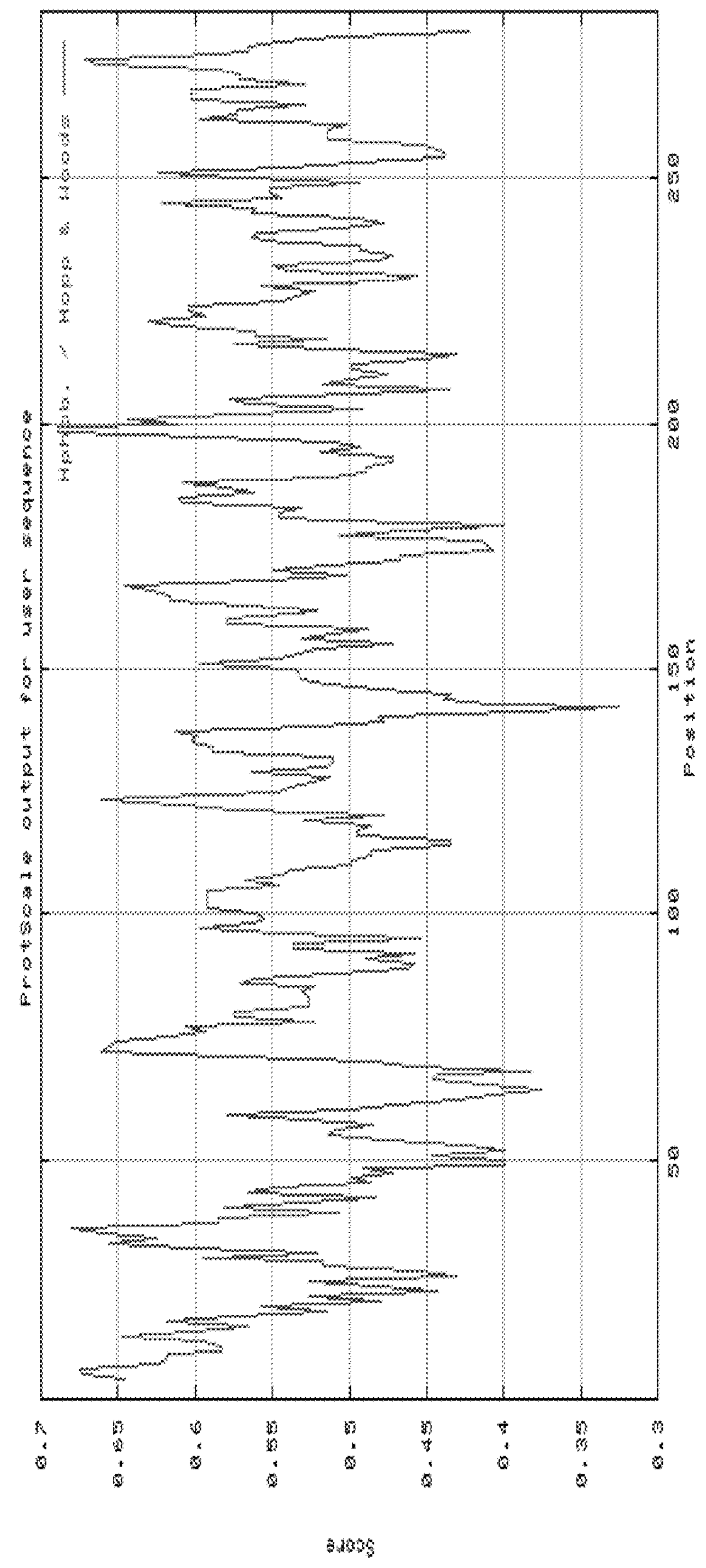

Figure 6A: 74P3B3 variant 1a Hydropathicity Profile
(Kyte J., Doolittle R.F., 1982. J. Mol. Biol. 157:105-132)
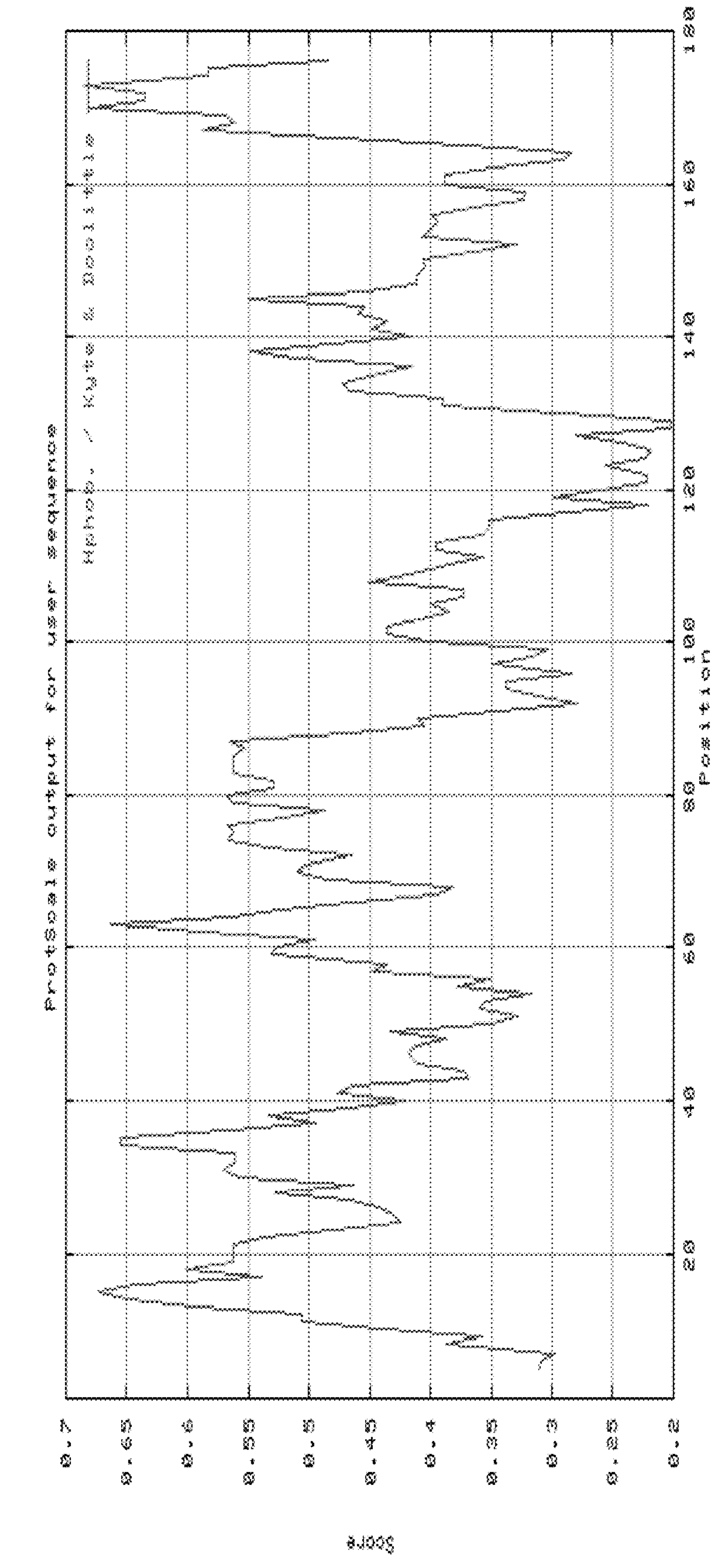

74P3B3 variant 1b Hydropathicity Profile
(Kyte J., Doolittle R.F., 1982. J. Mol. Biol. 157:105-132)

83P4B8 Hydropathicity Profile
(Kyte J., Doolittle R.F., 1982. J. Mol. Biol. 157:105-132)

109P1D4 Hydropathicity Profile
(Kyte J., Doolittle R.F., 1982. J. Mol. Biol. 157:105-132)

Figure 6E: 151P4E11 Hydropathicity Profile
(Kyte J., Doolittle R.F., 1982. J. Mol. Biol. 157:105-132)
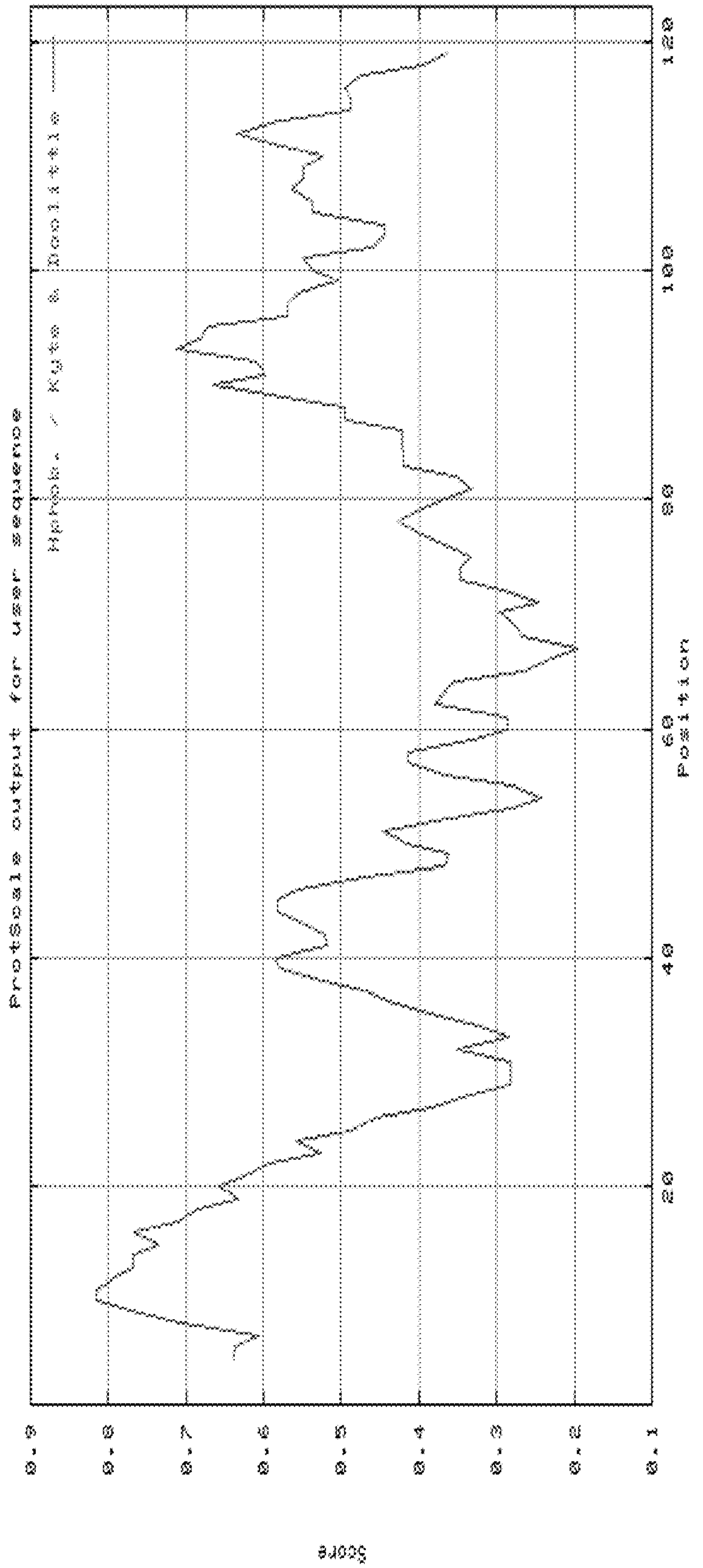

Figure 6F: 151P1C7a Hydropathicity Profile
(Kyte J., Doolittle R.F., 1982. J. Mol. Biol. 157:105-132)
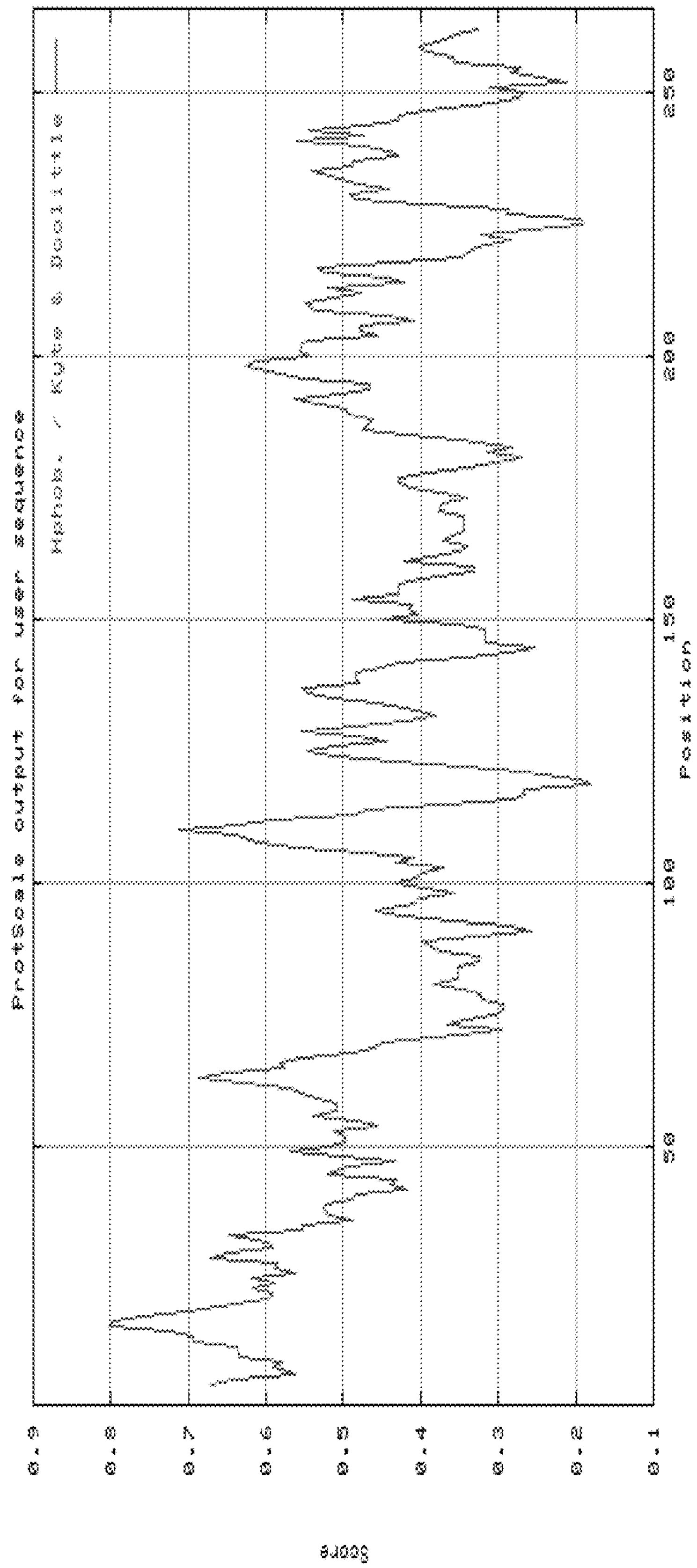

Figure 6G: 154P2A8 Hydropathicity Profile
(Kyte J., Doolittle R.F., 1982, J. Mol. Biol. 157:105-132)
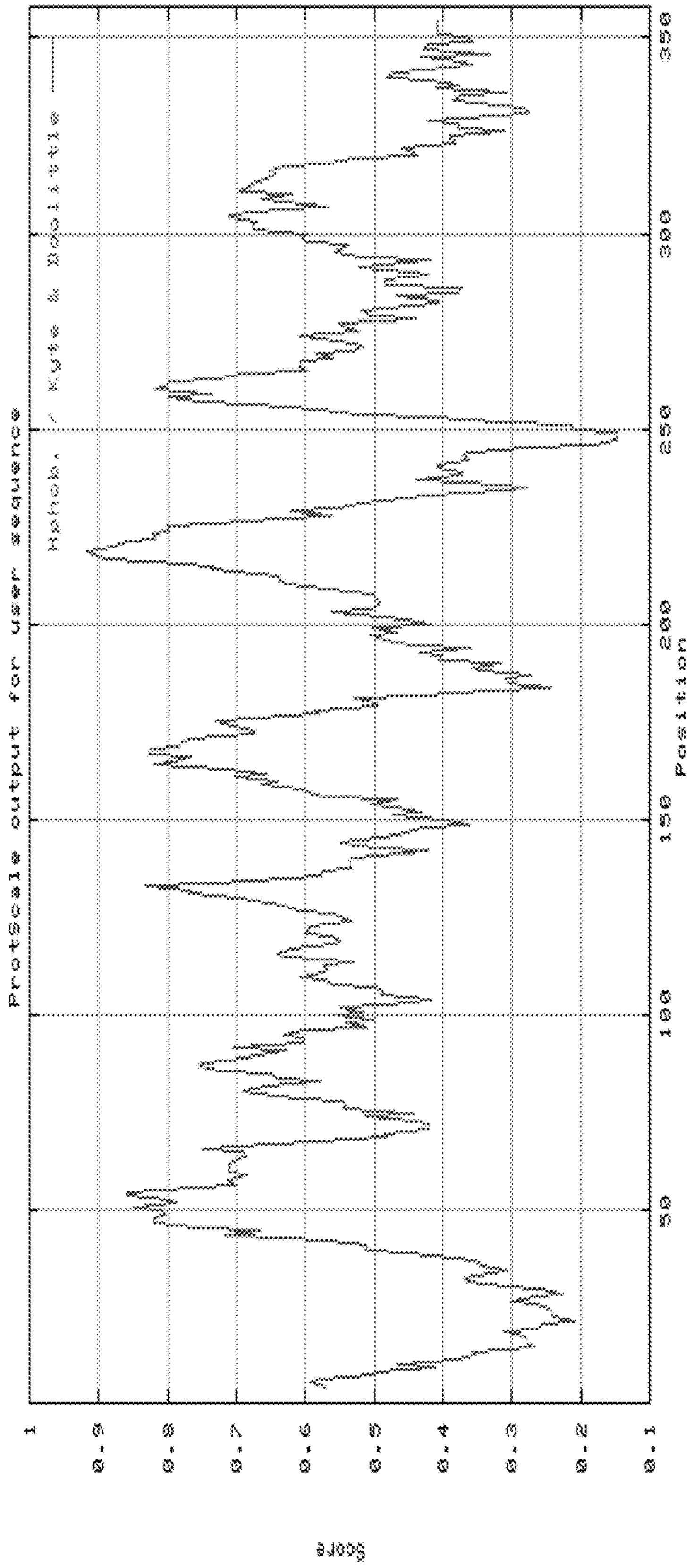

Figure 6H: 156P1D4 Hydropathicity Profile
(Kyte J., Doolittle R.F., 1982. J. Mol. Biol. 157:105-132)
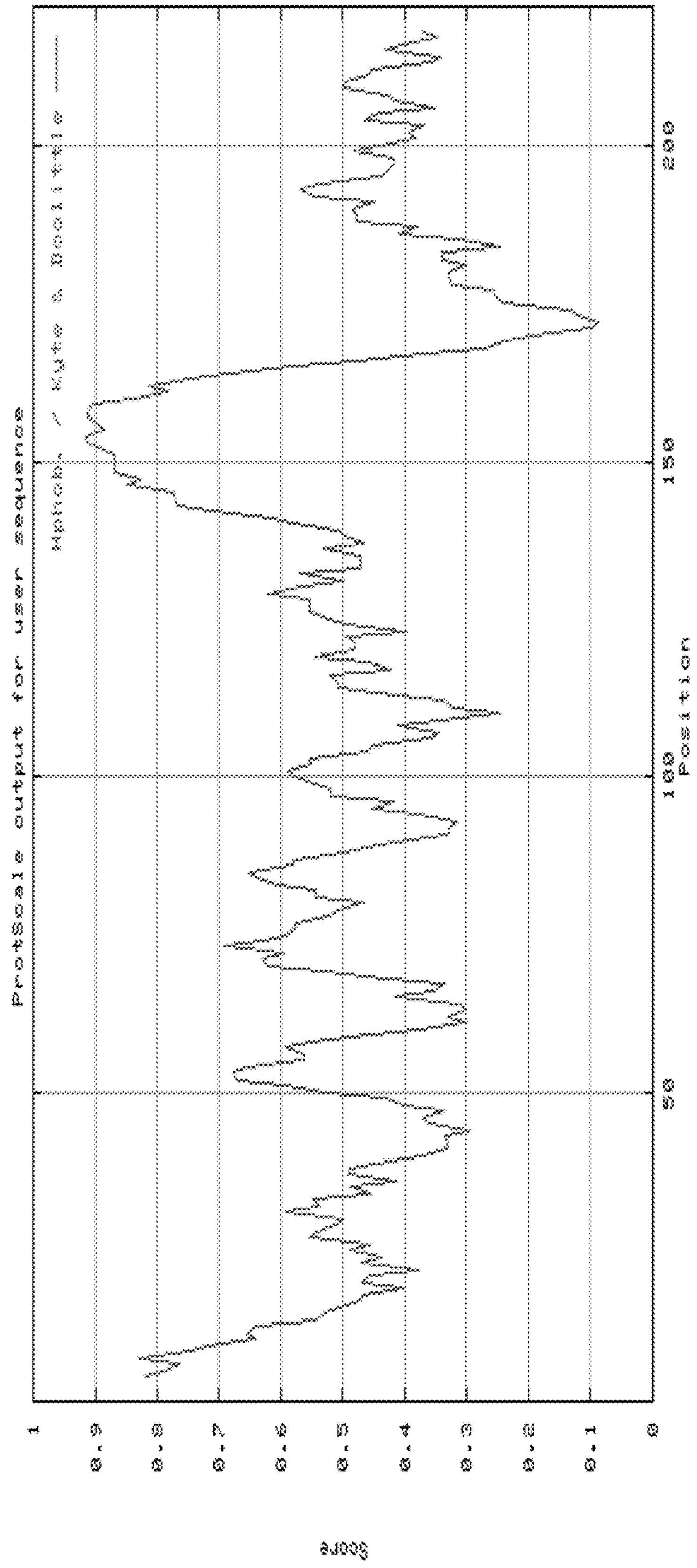

Figure 6I: 156P5C12 Hydropathicity Profile
(Kyte J., Doolittle R.F., 1982. J. Mol. Biol. 157:105-132)
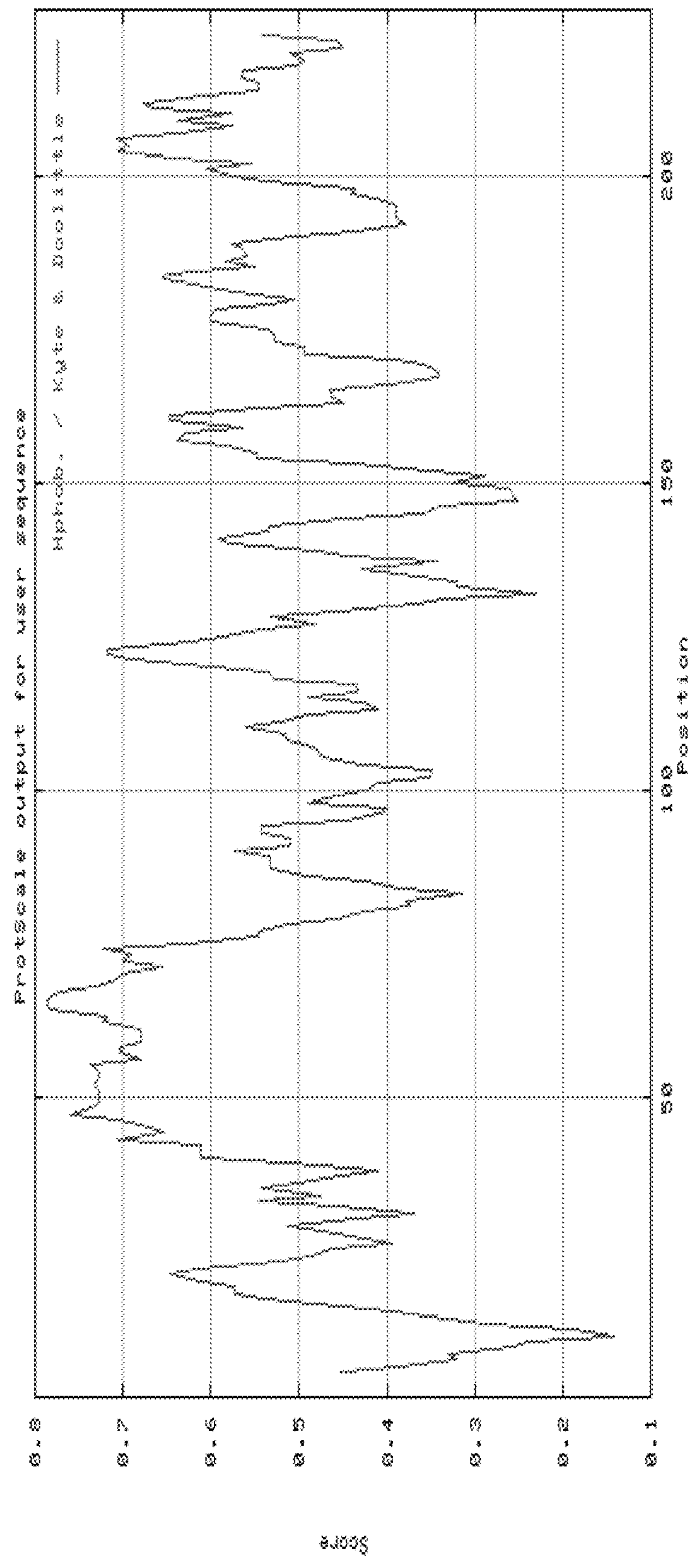

Figure 6J: 159P2B5 Hydropathicity Profile
(Kyte J., Doolittle R.F., 1982. J. Mol. Biol. 157:105-132)
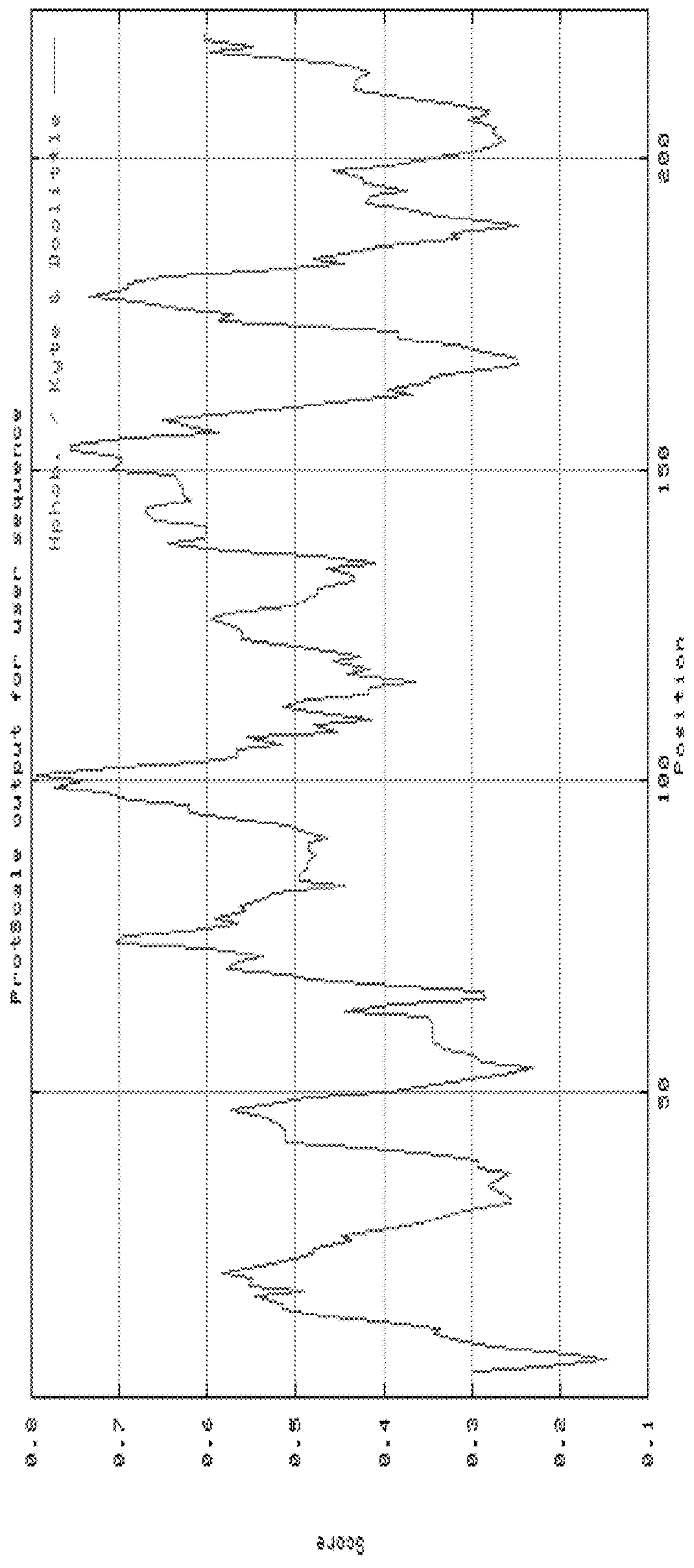

Figure 6K: 161P2B7a Hydropathicity Profile
(Kyte J., Doolittle R.F., 1982. J. Mol. Biol. 157:105-132)
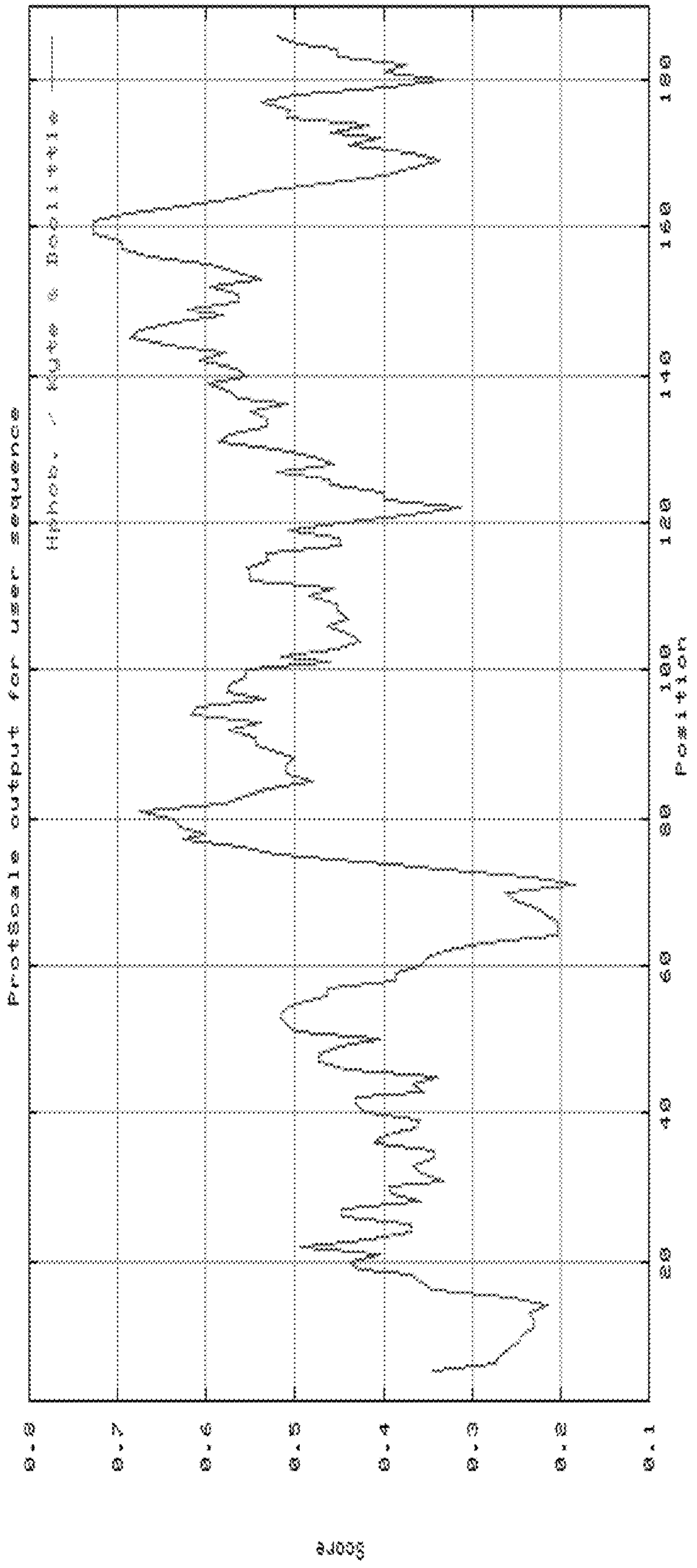

Figure 6L: 179P3G7 Hydropathicity Profile
(Kyte J., Doolittle R.F., 1982. J. Mol. Biol. 157:105-132)
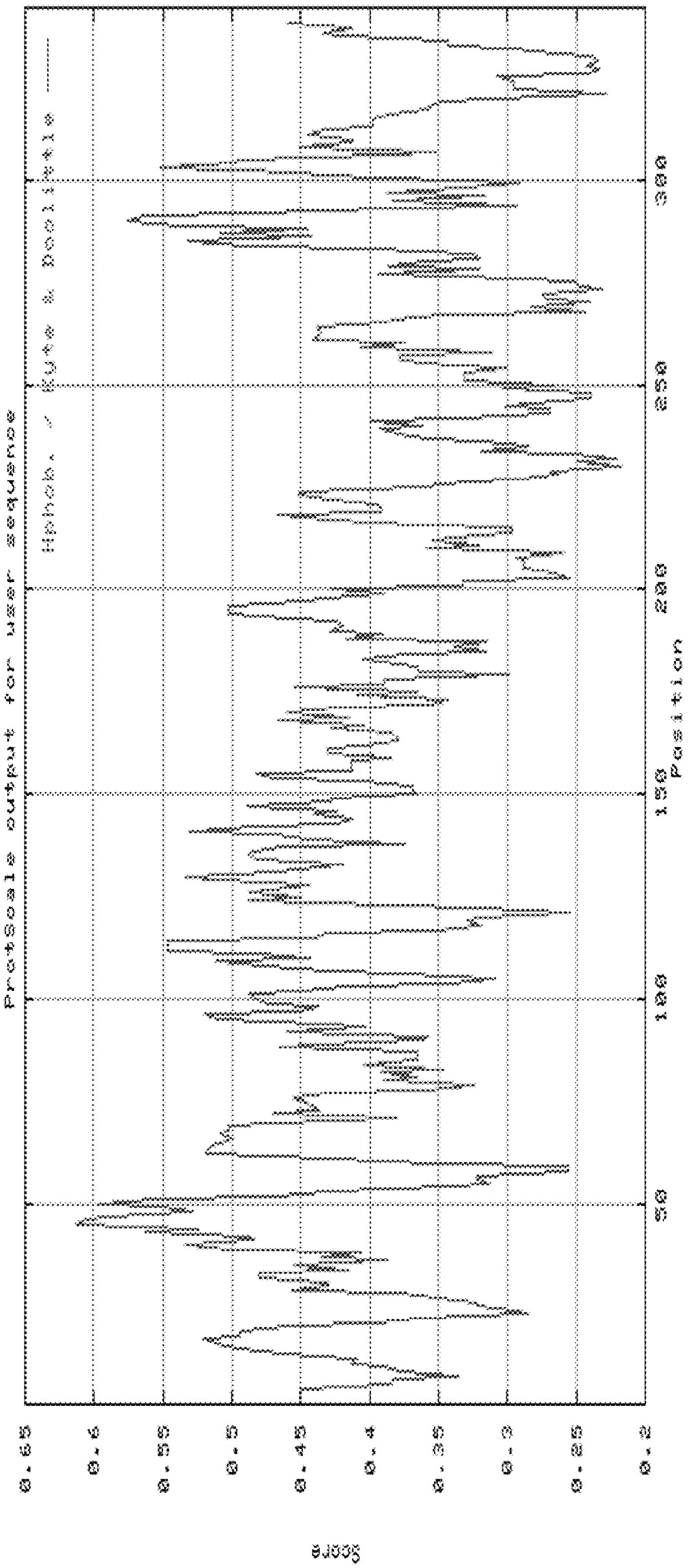

Figure 6M: 184P3C10b Hydropathicity Profile
(Kyte J., Doolittle R.F., 1982. J. Mol. Biol. 157:105-132)
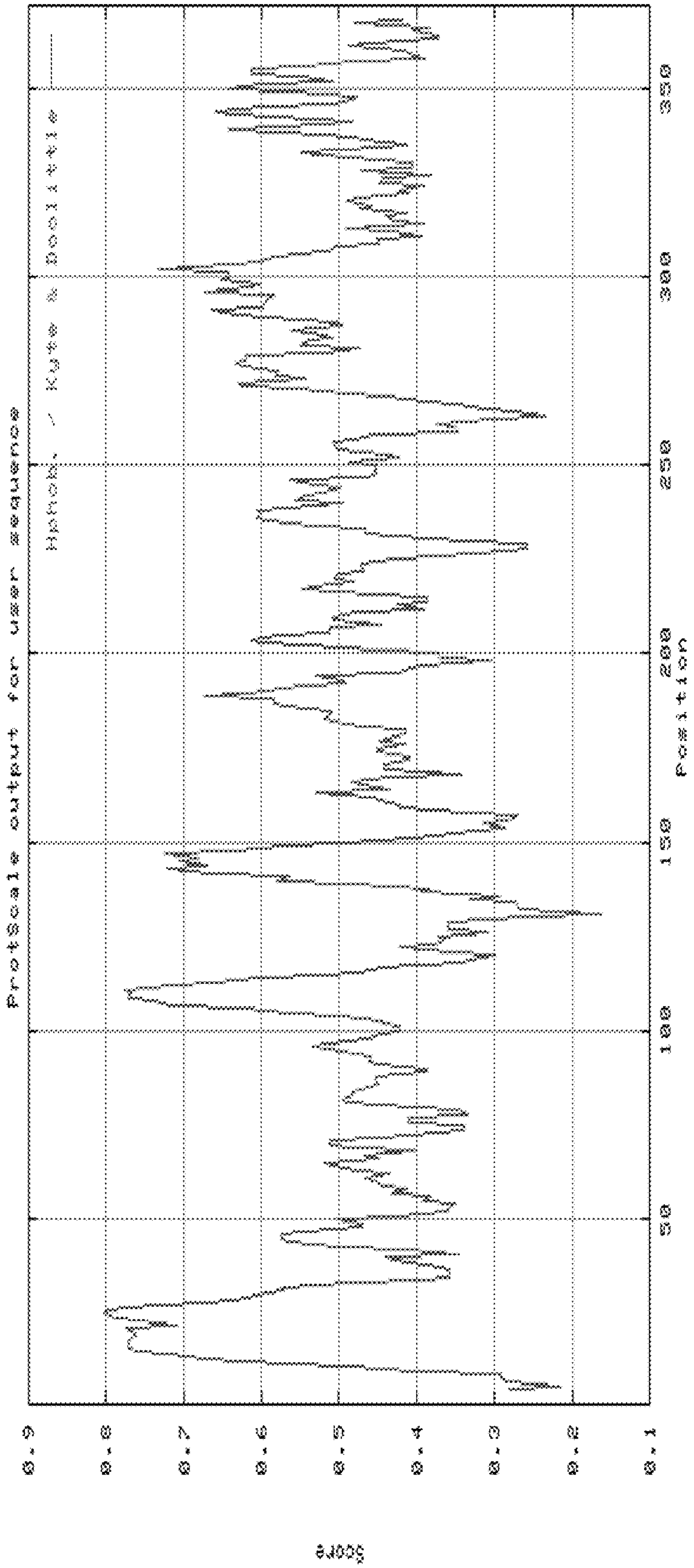

Figure 6N: 184P3G10 Hydropathicity Profile
(Kyte J., Doolittle R.F., 1982. J. Mol. Biol. 157:105-132)
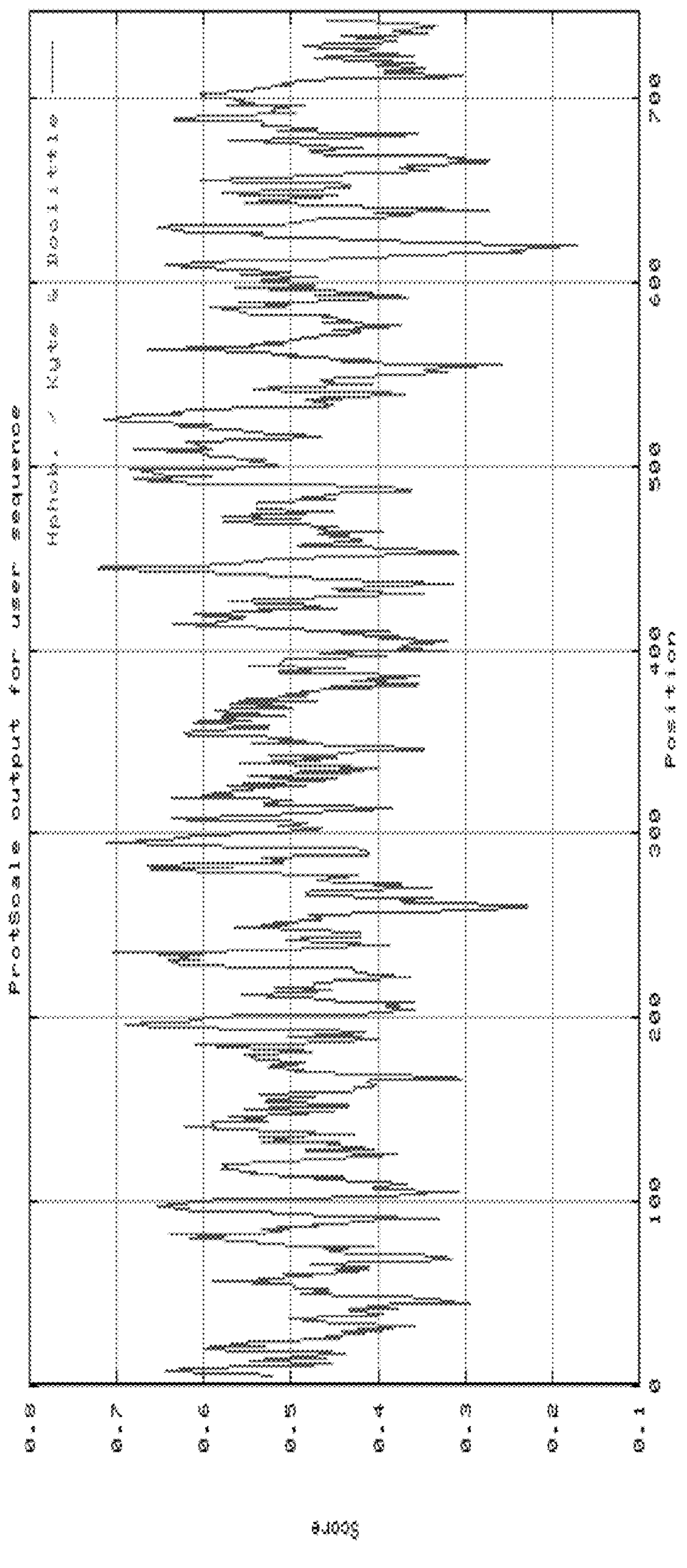

Figure 6O: 185P2C9 variant 1 Hydropathicity Profile
(Kyte J., Doolittle R.F., 1982. J. Mol. Biol. 157:105-132)
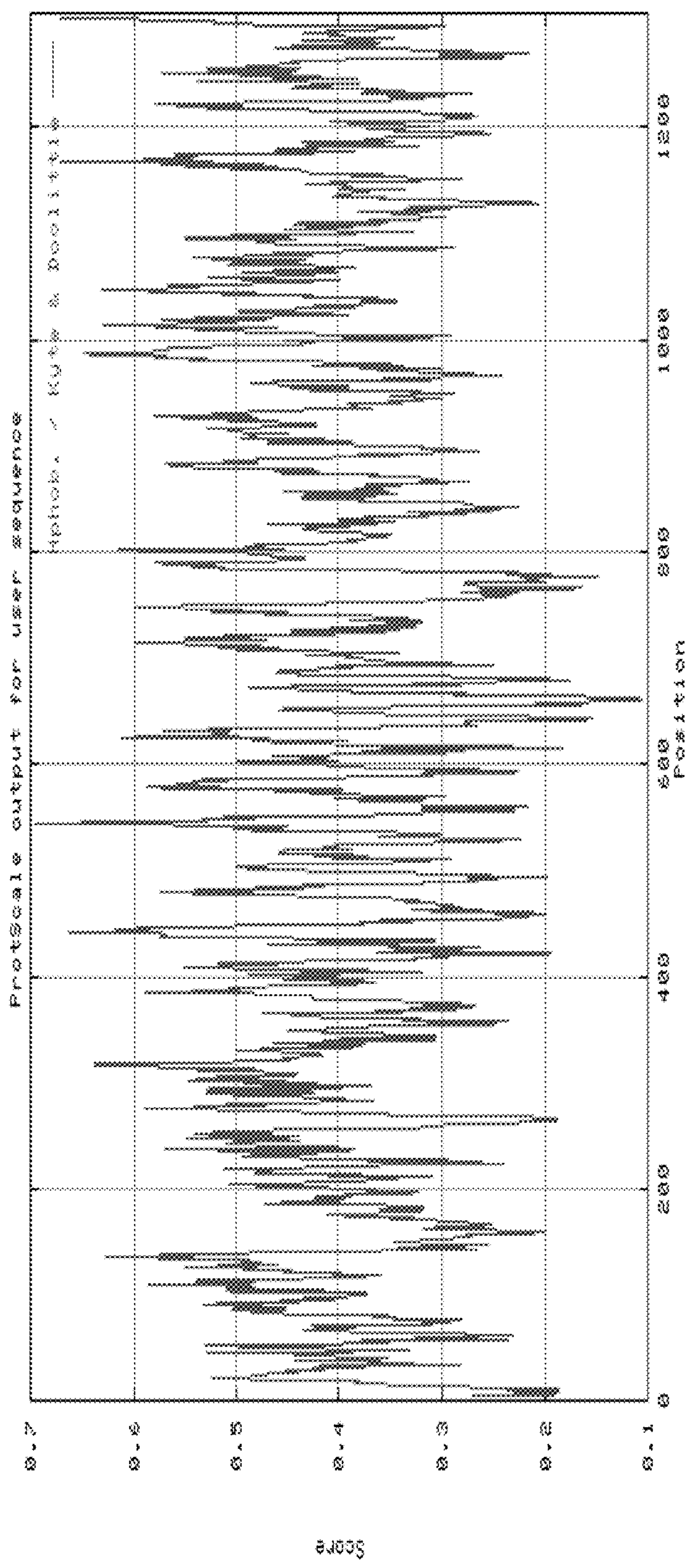

Figure 6P: 185P2C9 variant 2 Hydropathicity Profile
(Kyte J., Doolittle R.F., 1982. J. Mol. Biol. 157:105-132)
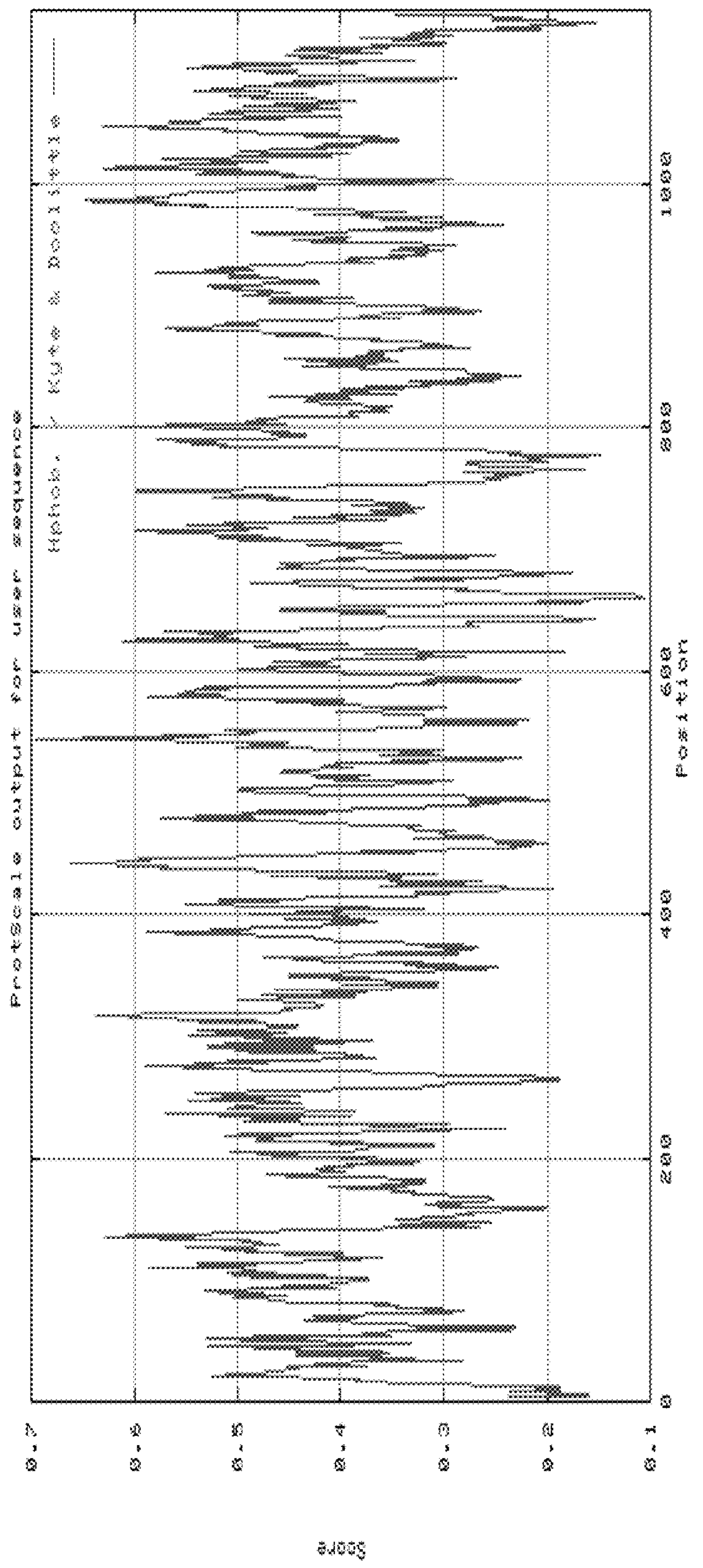

Figure 6Q: 185P2C9 variant 3 Hydropathicity Profile
(Kyte J., Doolittle R.F., 1982. J. Mol. Biol. 157:105-132)
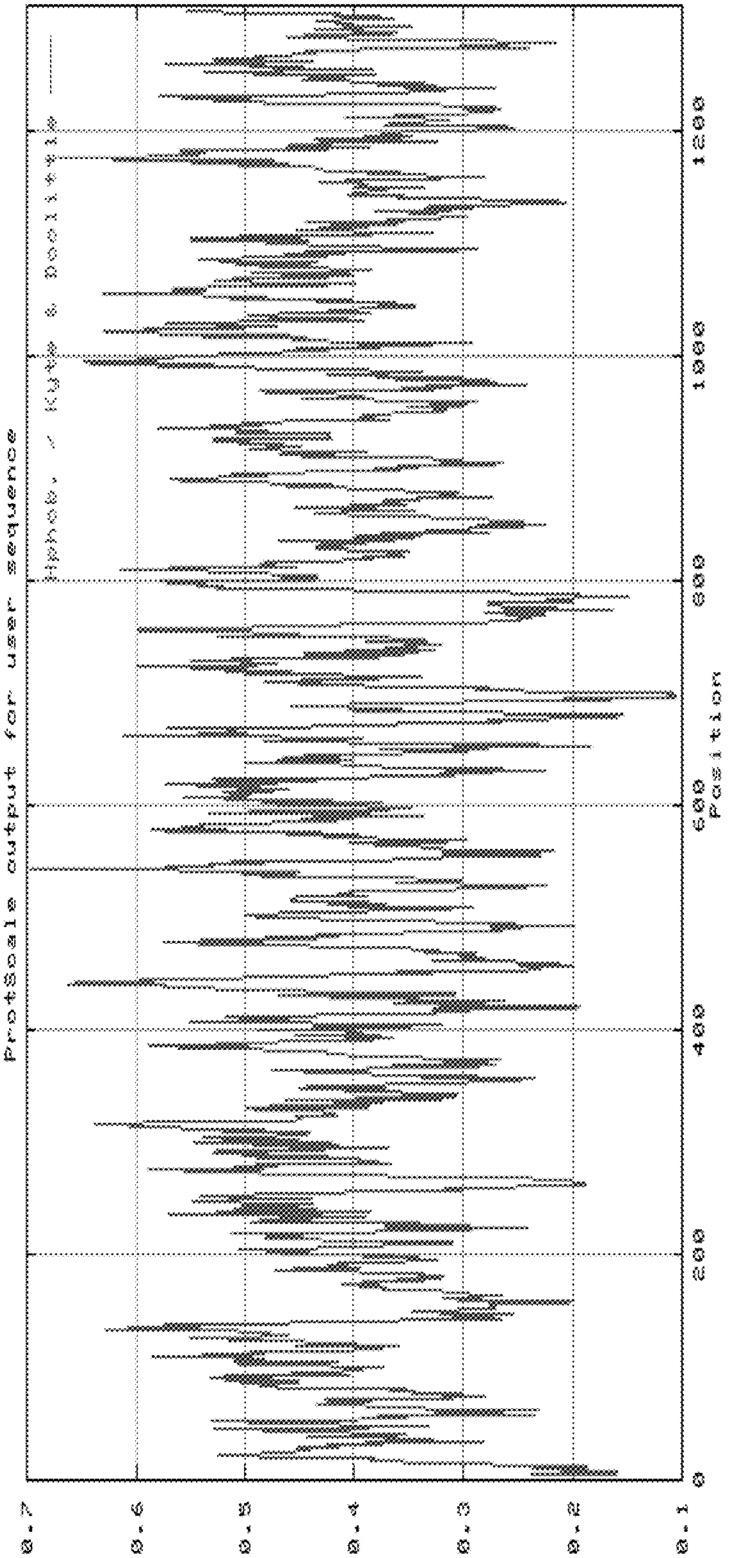

Figure 6R: 185P3C2 Hydropathicity Profile
(Kyte J., Doolittle R.F., 1982, J. Mol. Biol. 157:105-132)
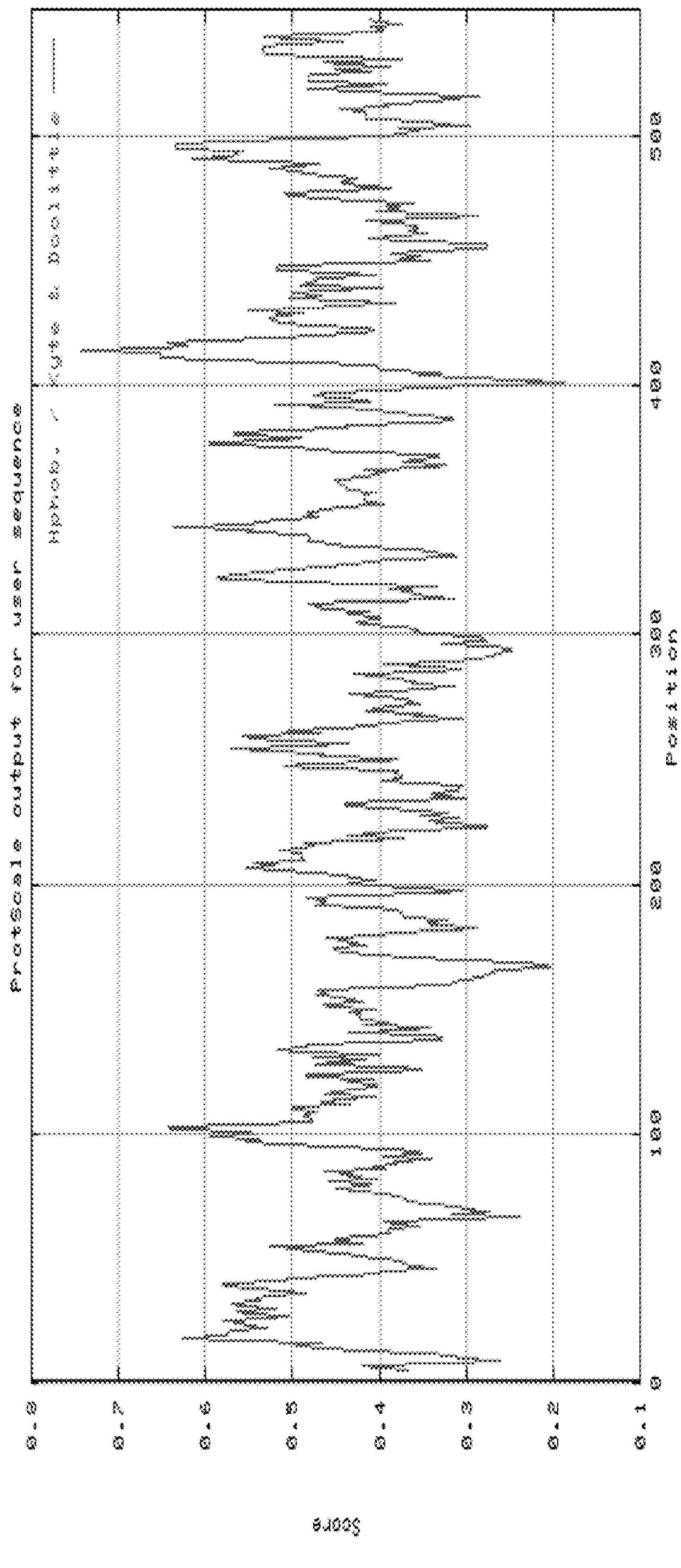

Figure 6S: 186P1H9 Hydropathicity Profile
(Kyte J., Doolittle R.F., 1982. J. Mol. Biol. 157:105-132)
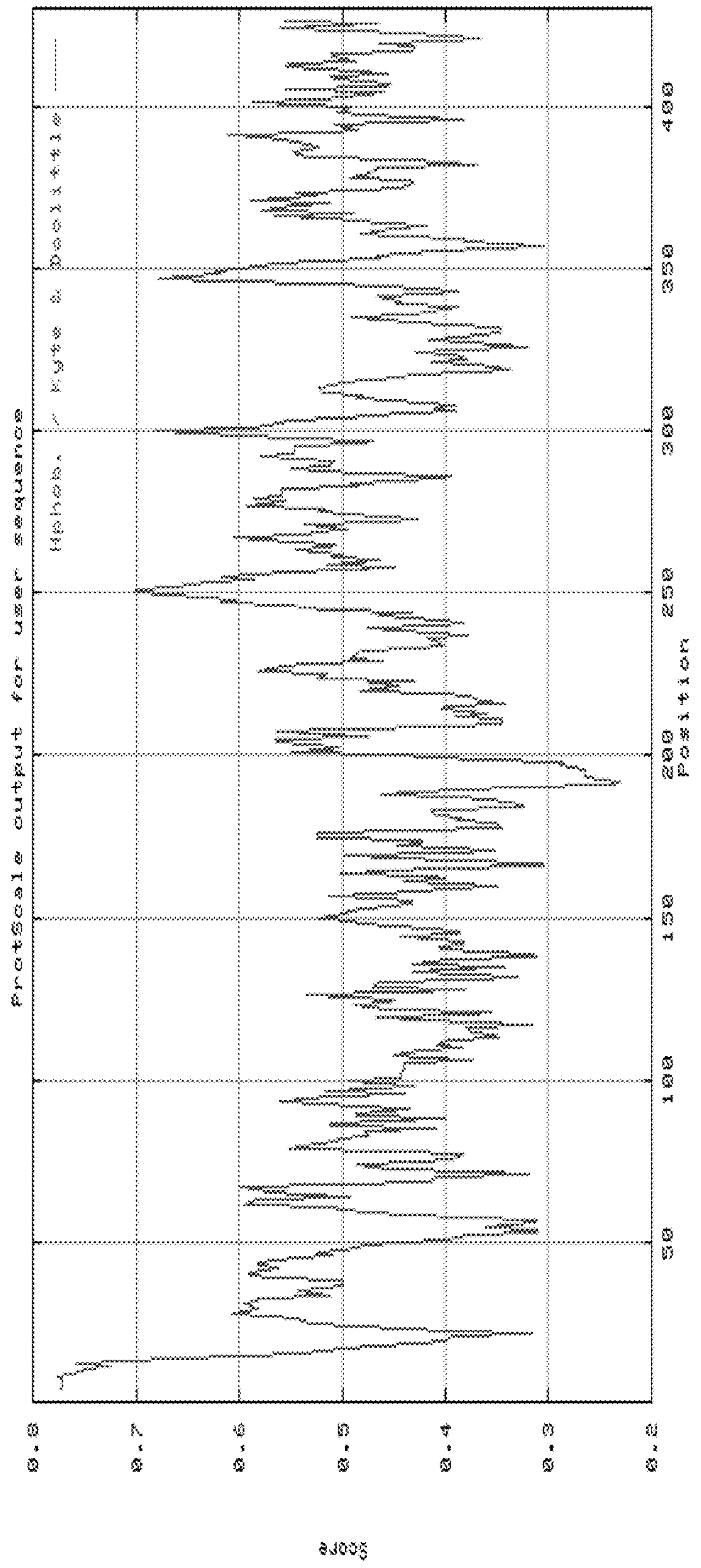

Figure 6T: 187P3F2 Hydropathicity Profile
(Kyte J., Doolittle R.F., 1982. J. Mol. Biol. 157:105-132)
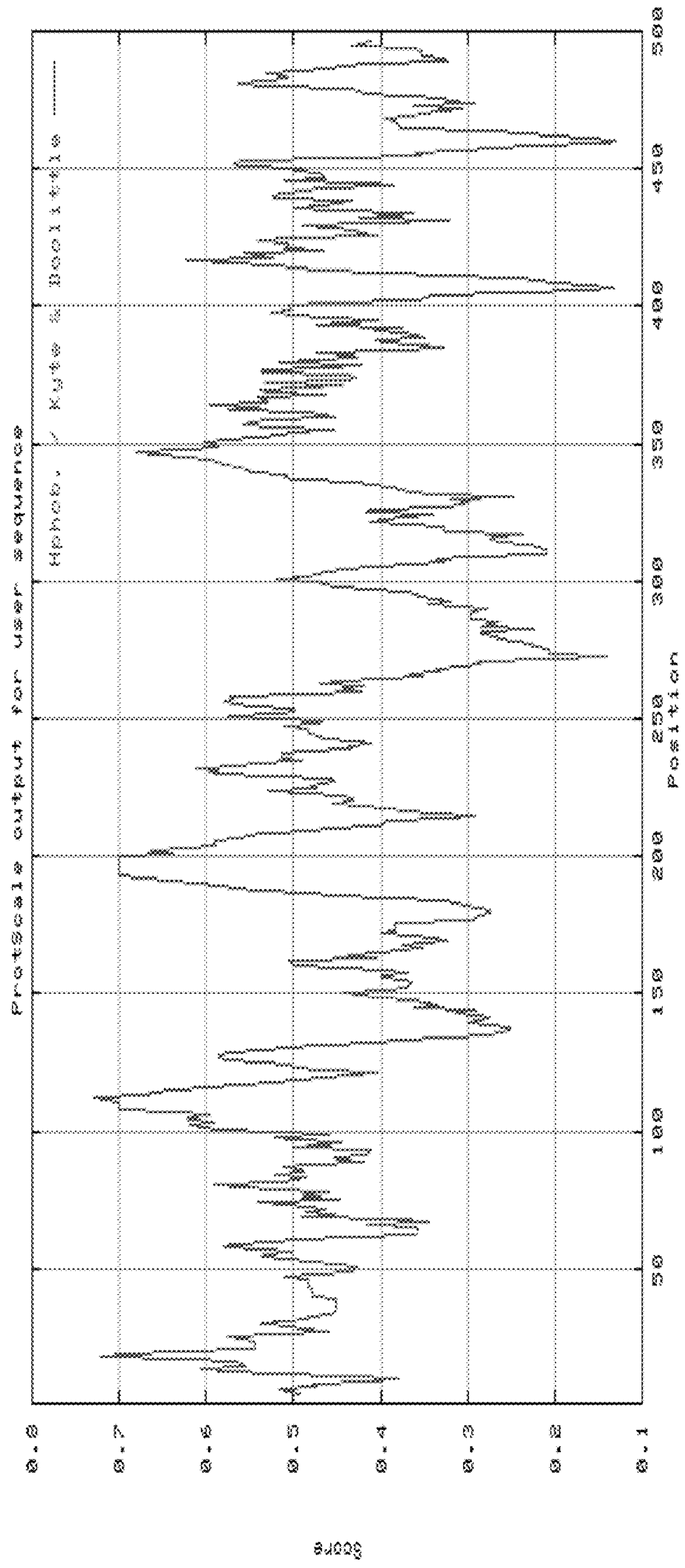

Figure 6U: 192P2G7 Hydropathicity Profile
(Kyte J., Doolittle R.F., 1982. J. Mol. Biol. 157:105-132)
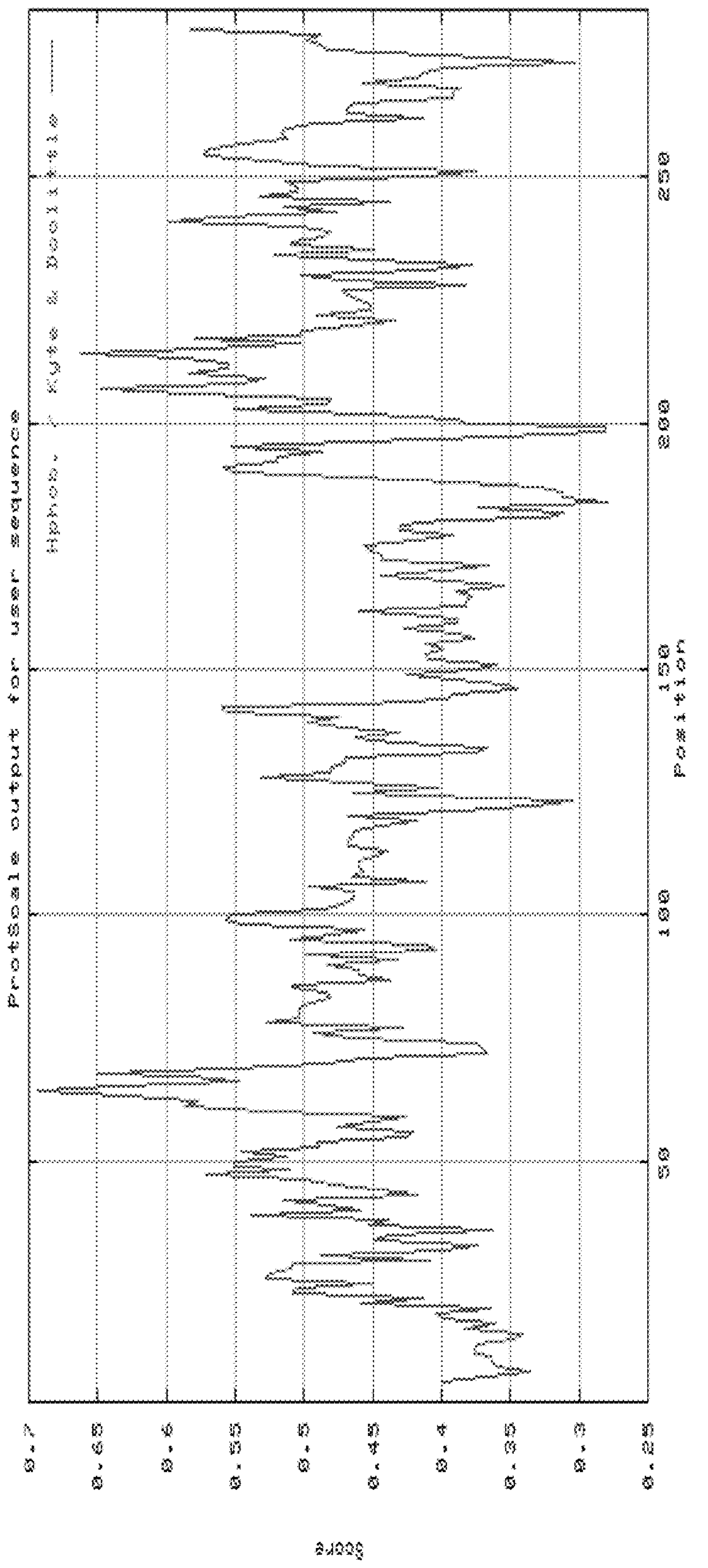

74P3B3 variant 1a % Accessible Residues Profile
(Janin J., 1979. Nature 277:491-492)

74P3B3 variant 1b % Accessible Residues Profile
(Janin J., 1979, Nature 277:491-492)

83P4B8 % Accessible Residues Profile (Janin J., 1979, Nature 277:491-492)

109P1D4 % Accessible Residues Profile
(Janin J., 1979, Nature 277:491-492)

Figure 7E: 151P4E11 % Accessible Residues Profile
(Janin J., 1979. Nature 277:491-492)
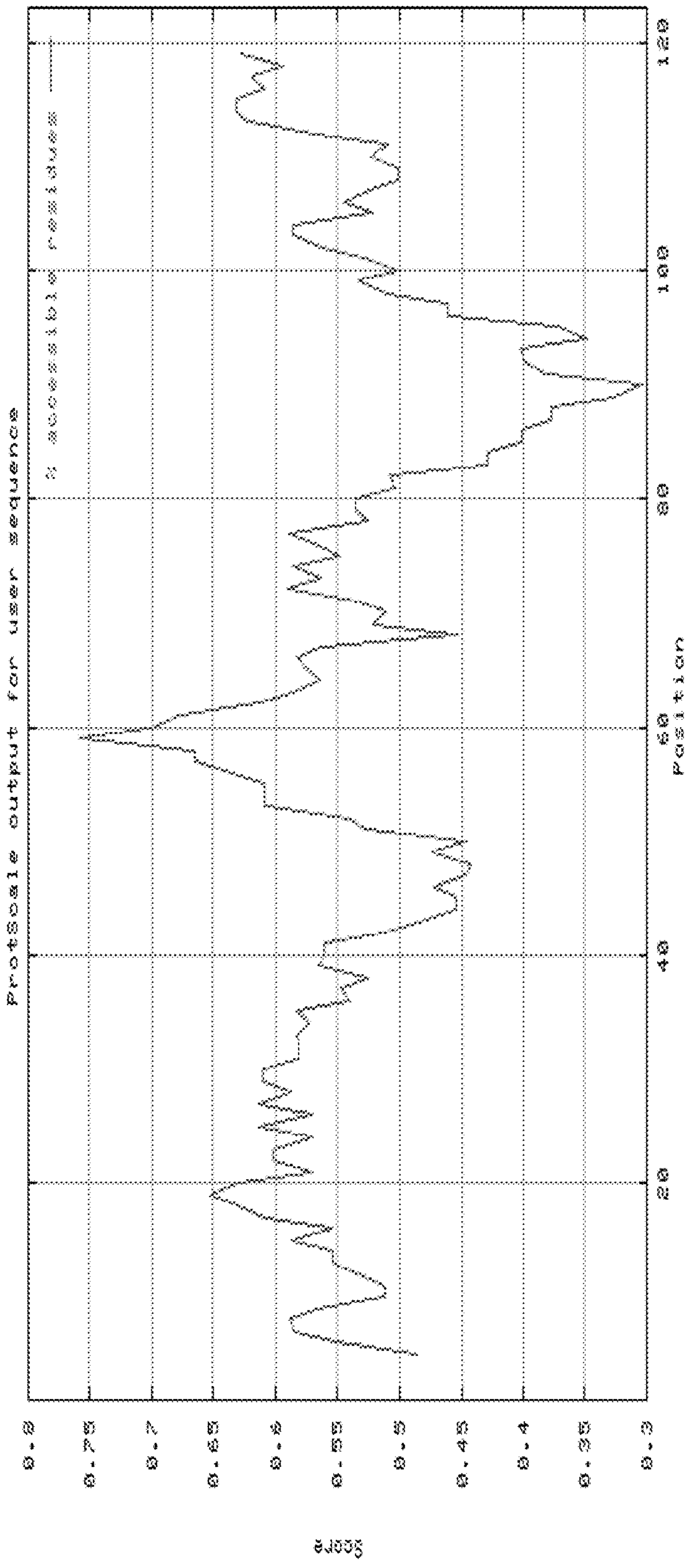

Figure 7F: 151P1C7a % Accessible Residues Profile
(Janin J., 1979, Nature 277:491-492)
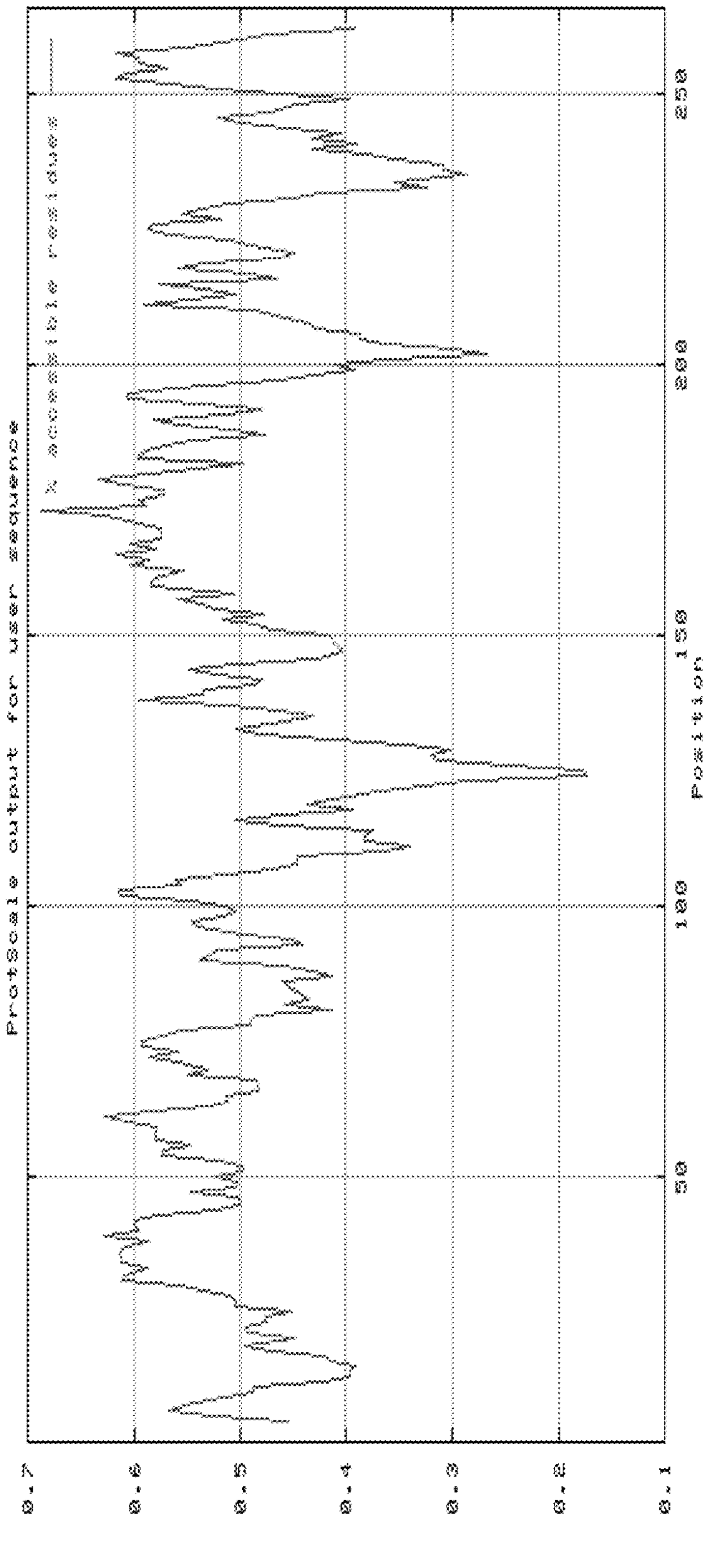

Figure 7G: 154P2A8 % Accessible Residues Profile
(Janin J., 1979. Nature 277:491-492)
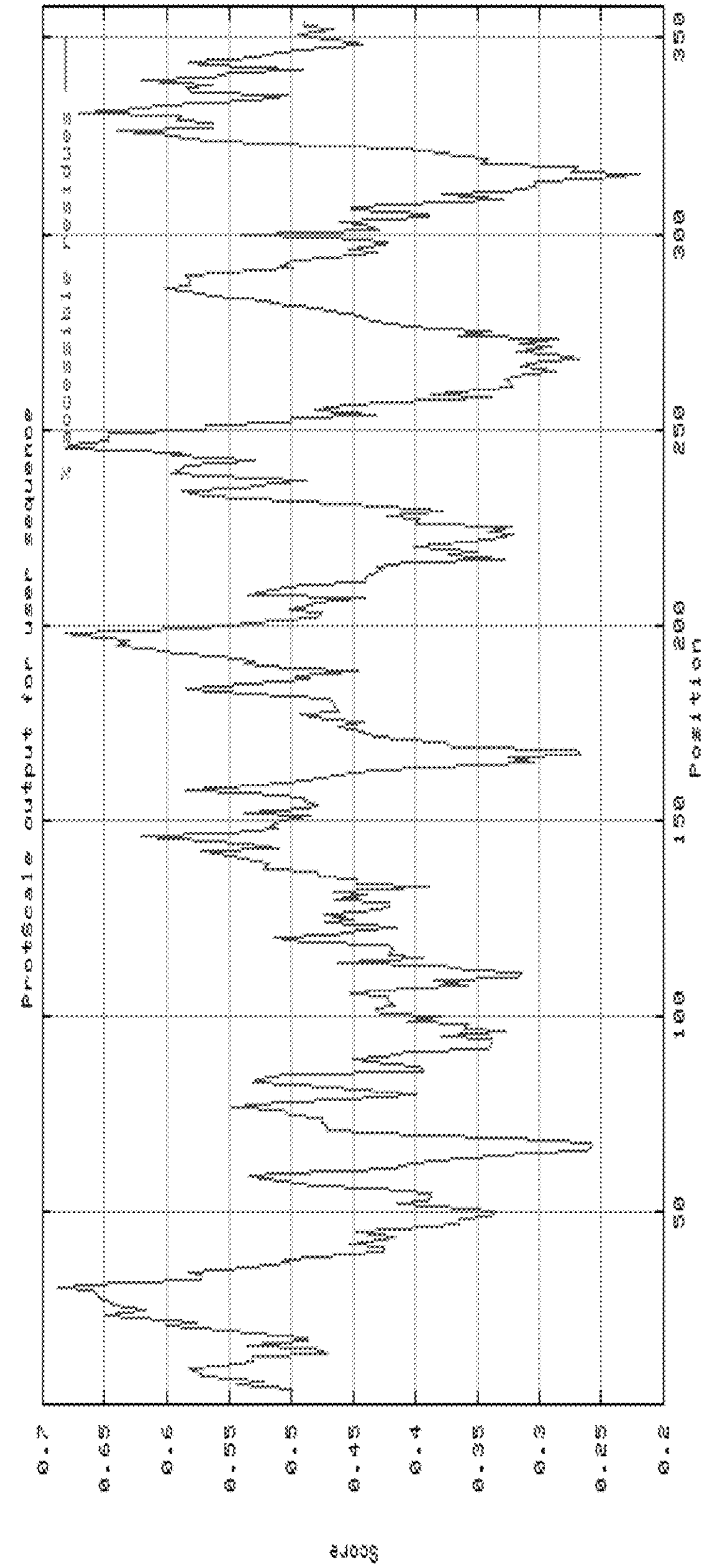

Figure 7H: 156P1D4 % Accessible Residues Profile
(Janin J., 1979, Nature 277:491-492)
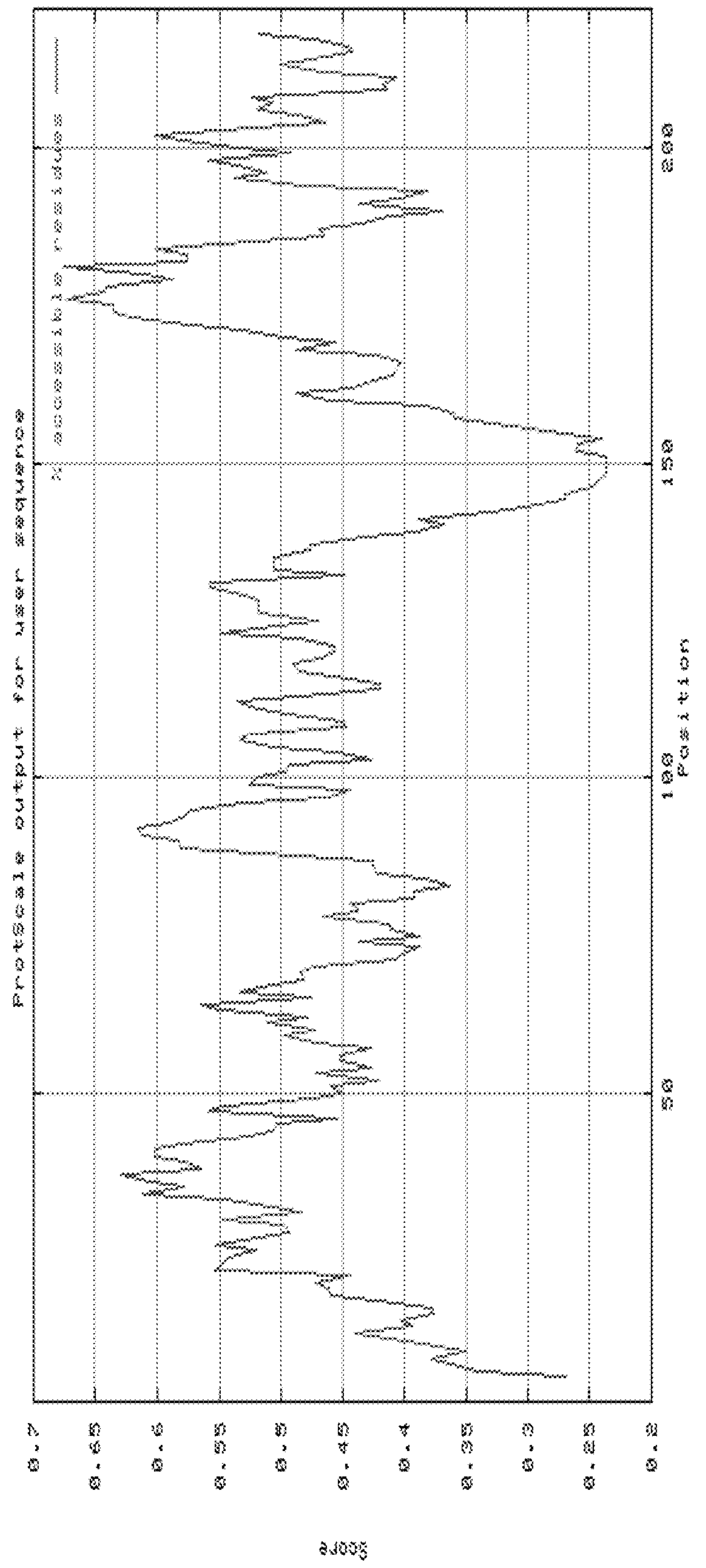

Figure 7I: 156P5C12 % Accessible Residues Profile
(Janin J., 1979. Nature 277:491-492)
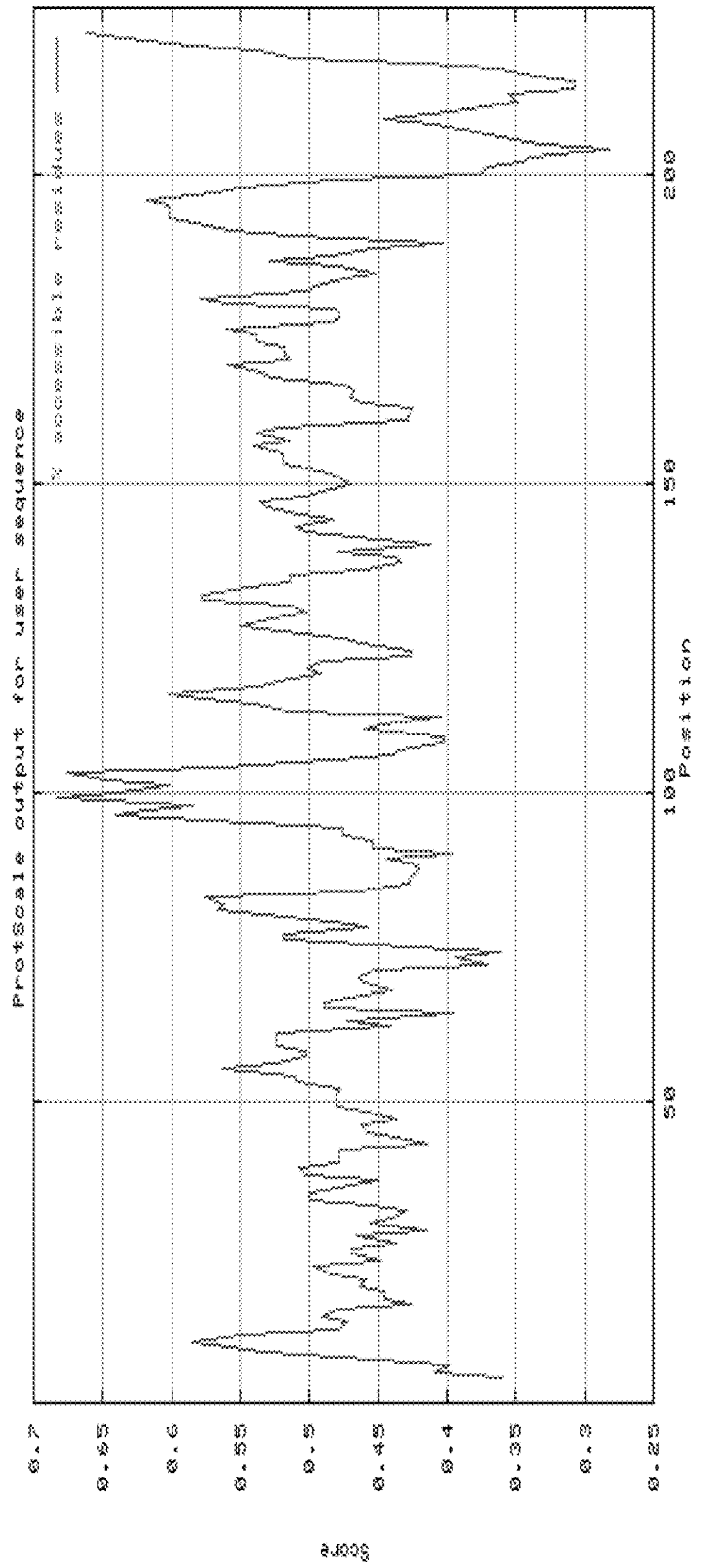

Figure 7J: 159P2B5 % Accessible Residues Profile
(Janin J., 1979. Nature 277:491-492)
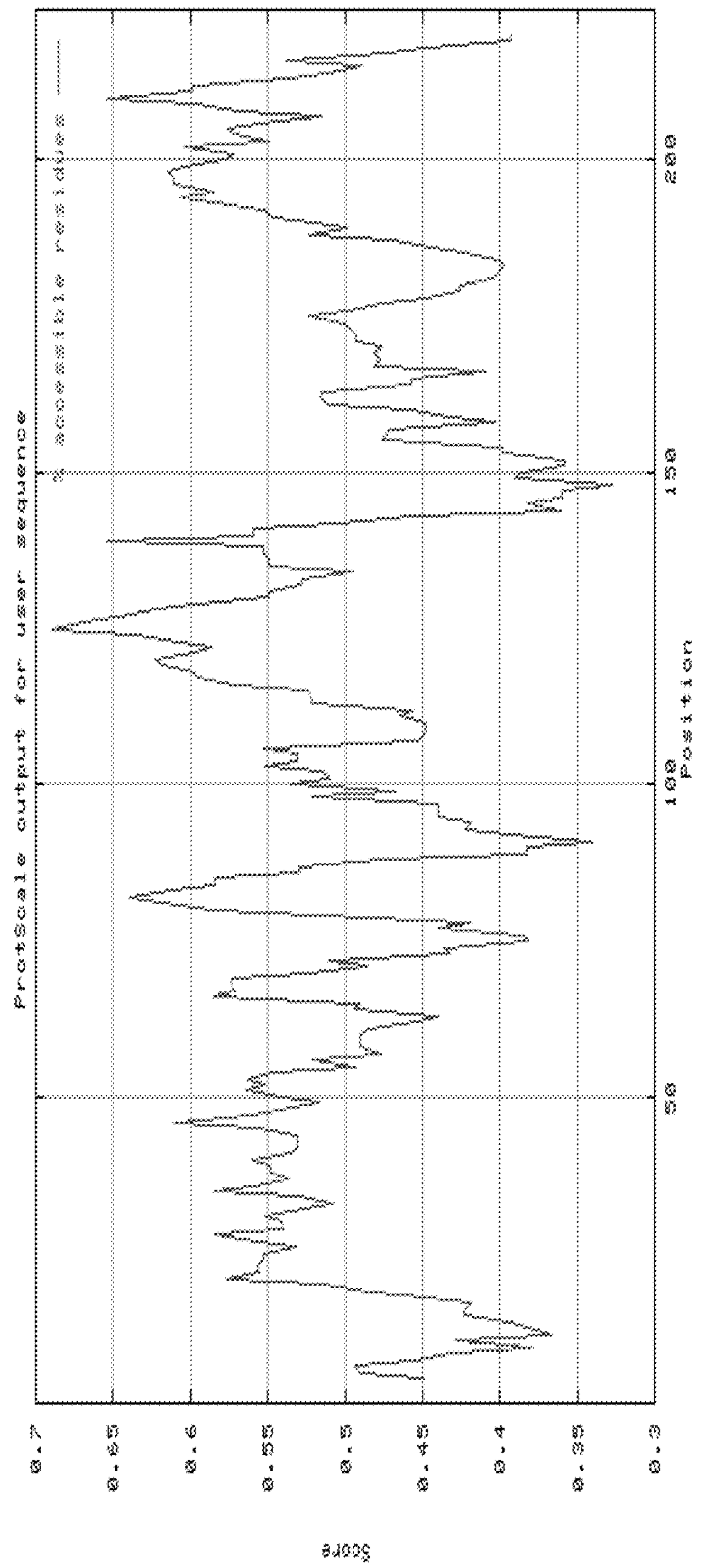

Figure 7K: 161P2B7a % Accessible Residues Profile
(Janin J., 1979, Nature 277:491-492)
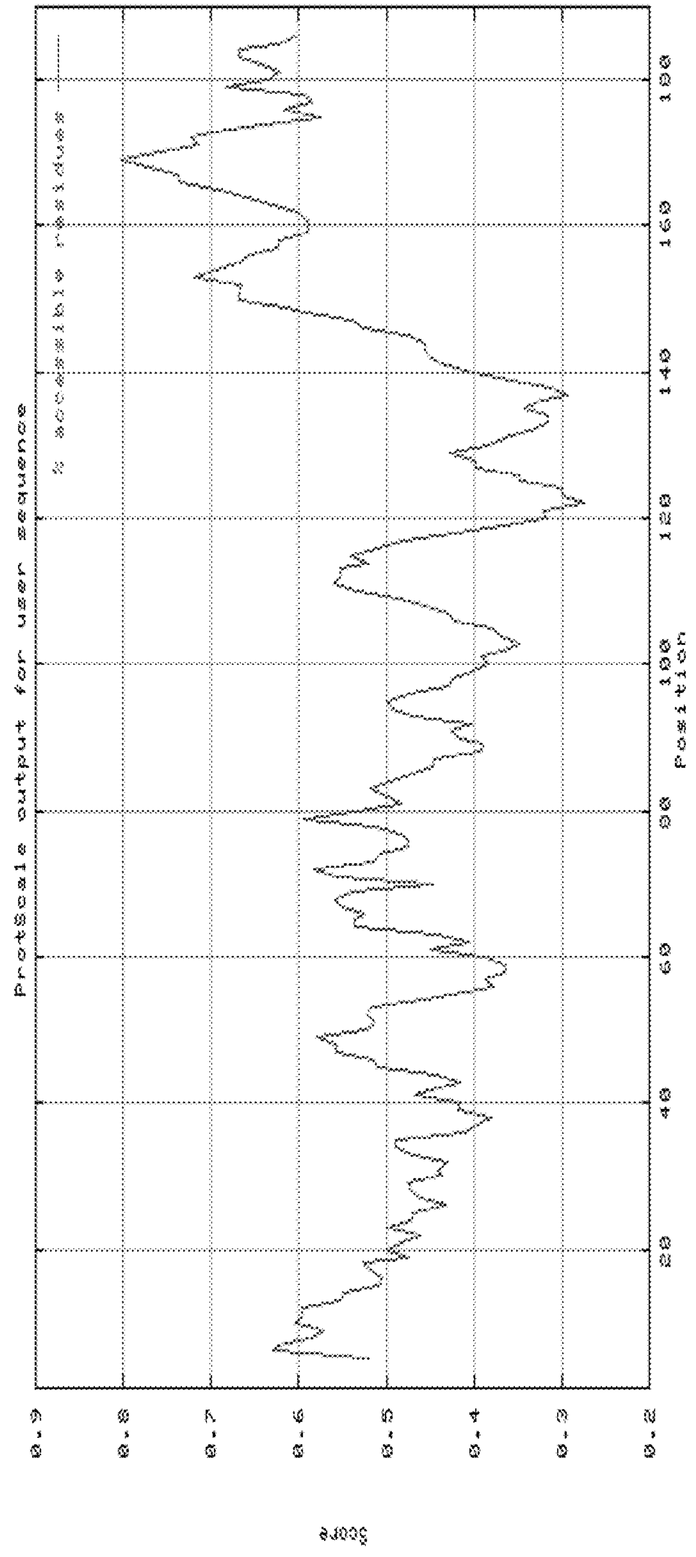

Figure 7L: 179P3G7 % Accessible Residues Profile
(Janin J., 1979. Nature 277:491-492)
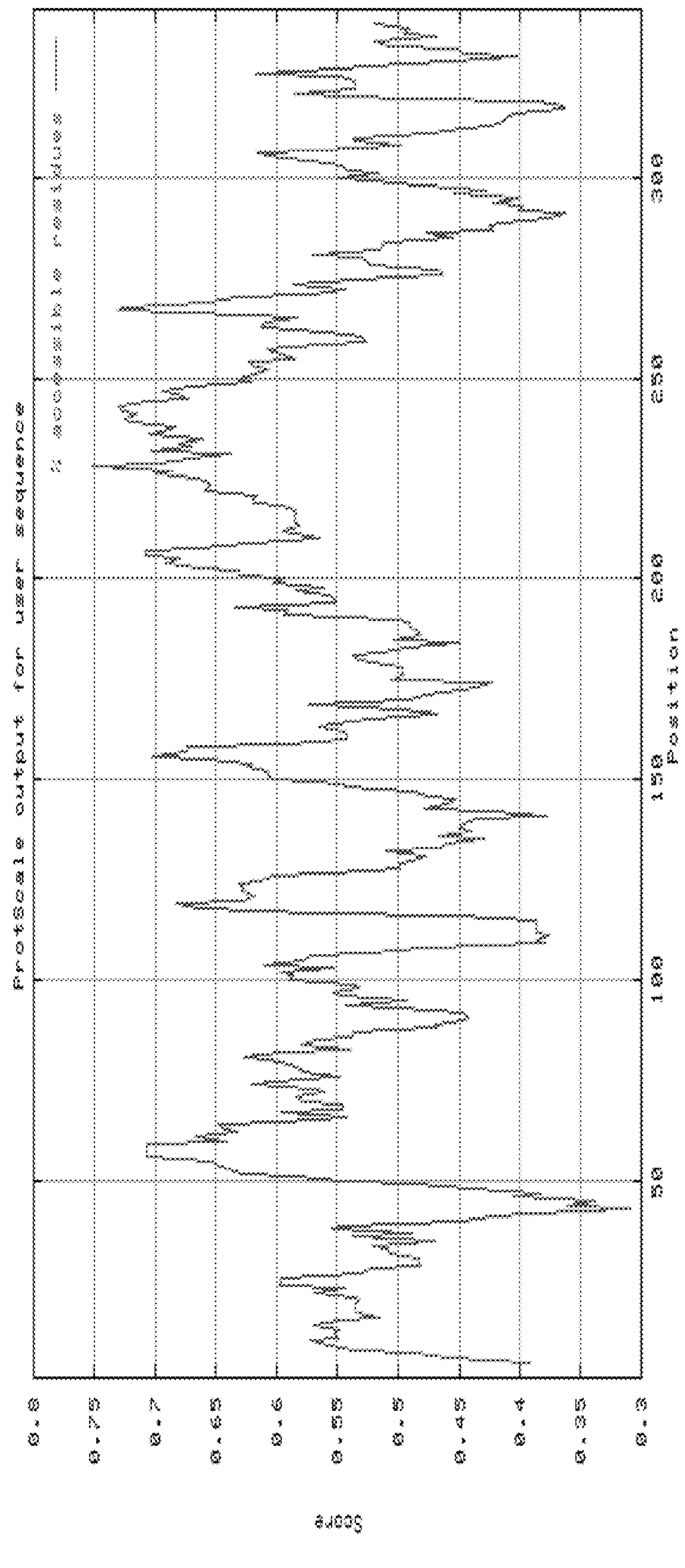

Figure 7M: 184P3C10b % Accessible Residues Profile
(Janin J., 1979, Nature 277:491-492)
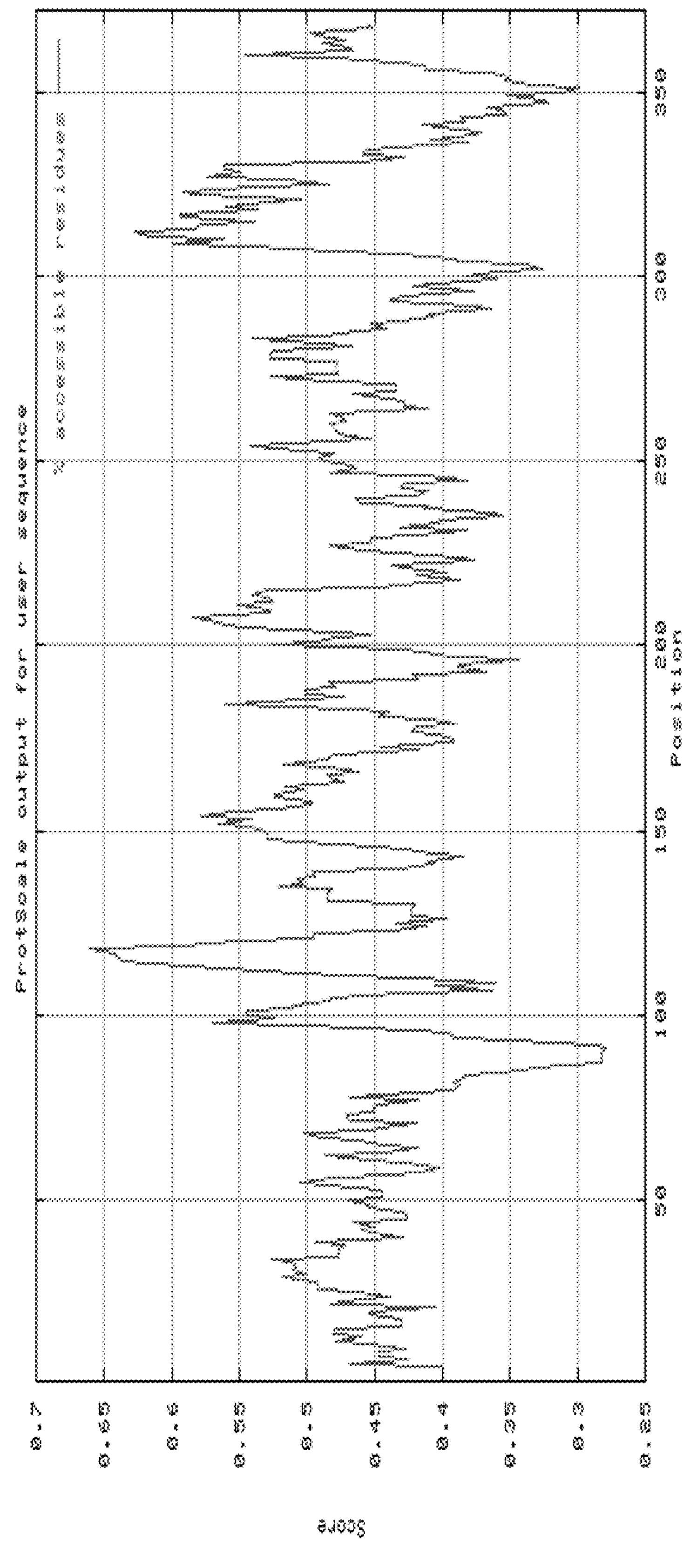

Figure 7N: 184P3G10 % Accessible Residues Profile
(Janin J., 1979. Nature 277:491-492)
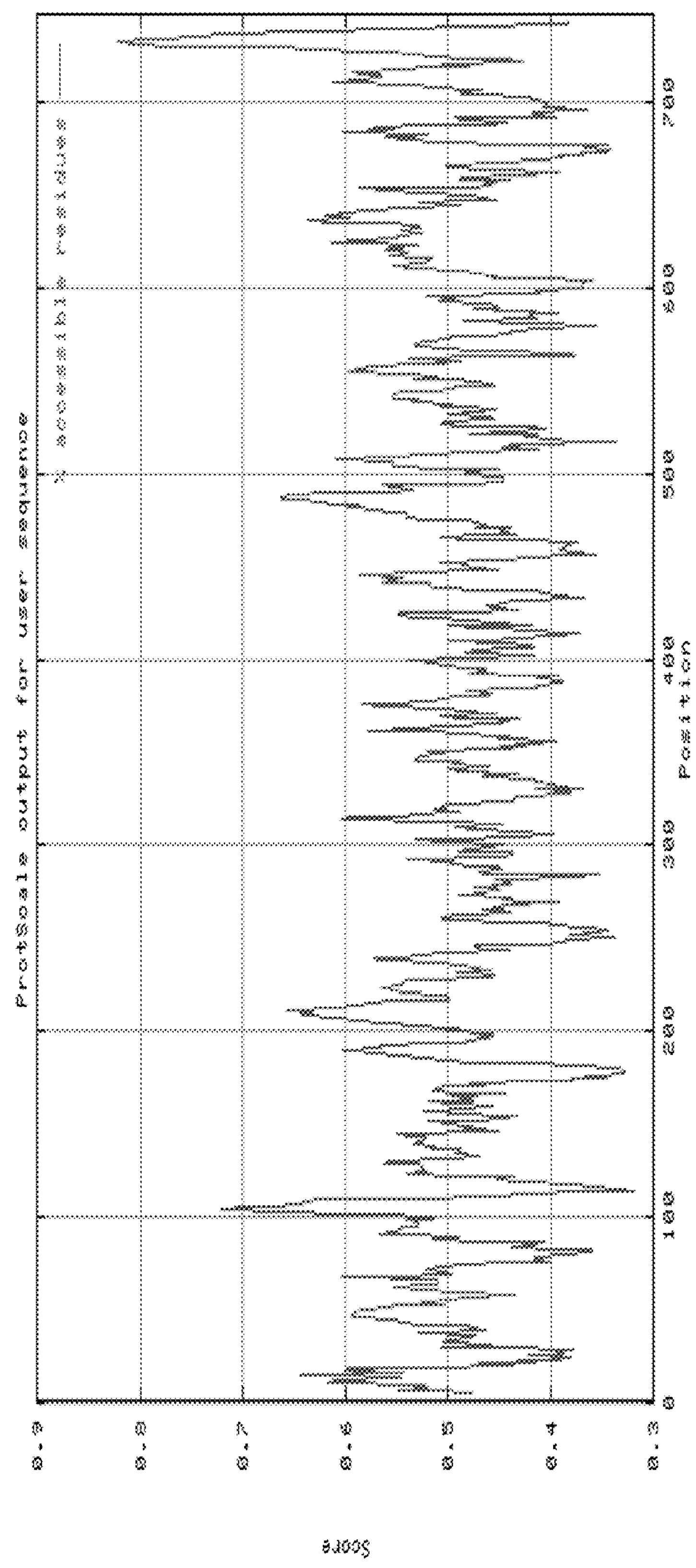

Figure 7O: 185P2C9 variant 1 % Accessible Residues Profile
(Janin J., 1979. Nature 277:491-492)
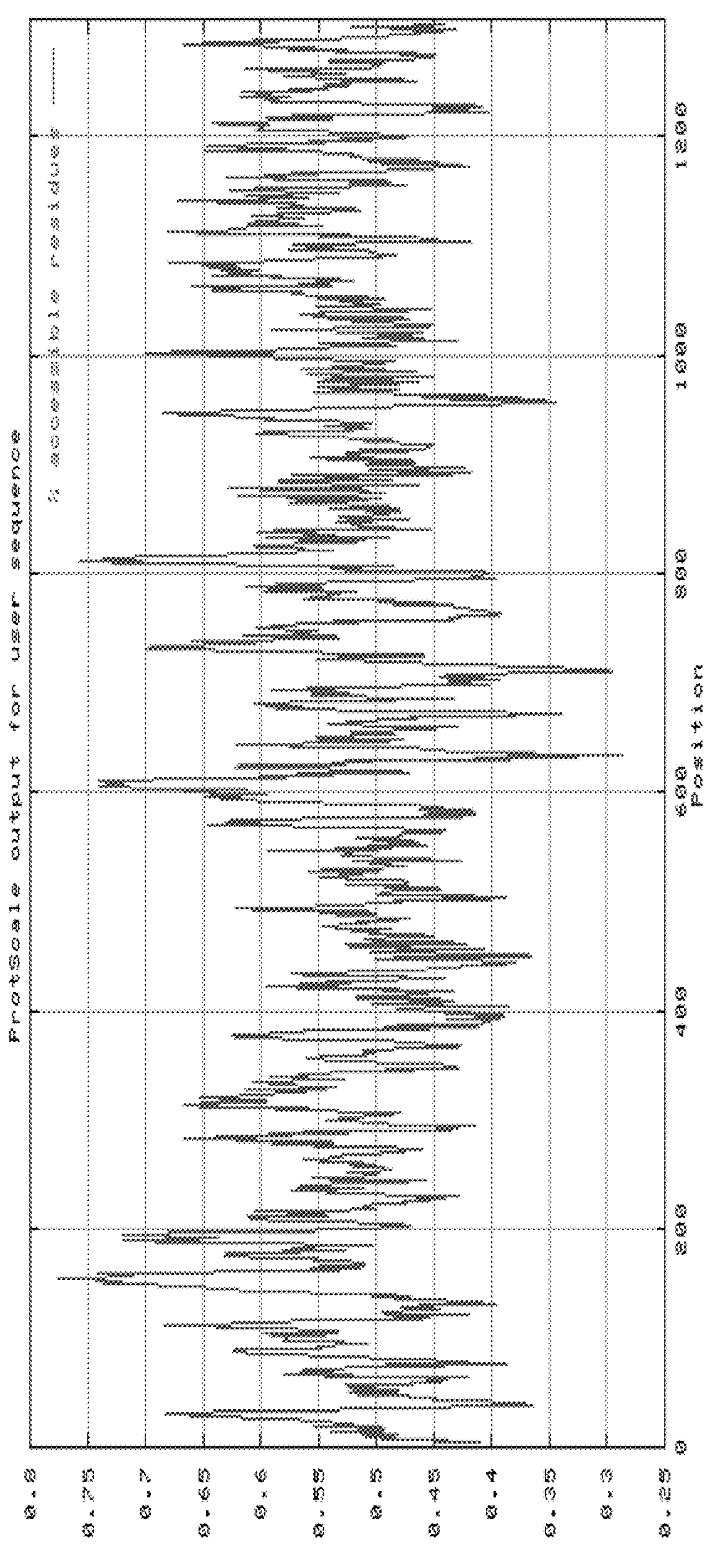

Figure 7P: 185P2C9 variant 2 % Accessible Residues Profile
(Janin J., 1979. Nature 277:491-492)
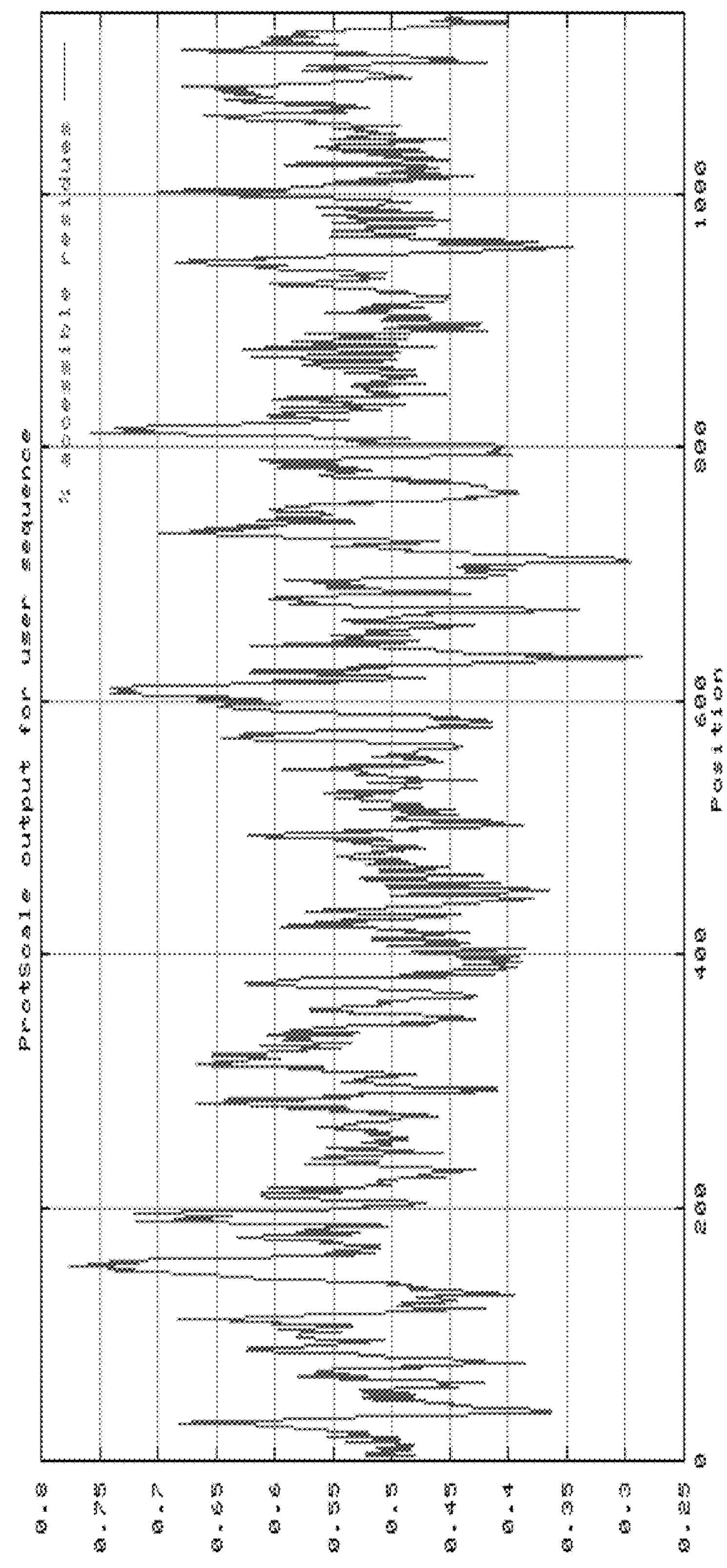

Figure 7Q: 185P2C9 variant 3 % Accessible Residues Profile
(Janin J., 1979. Nature 277:491-492)
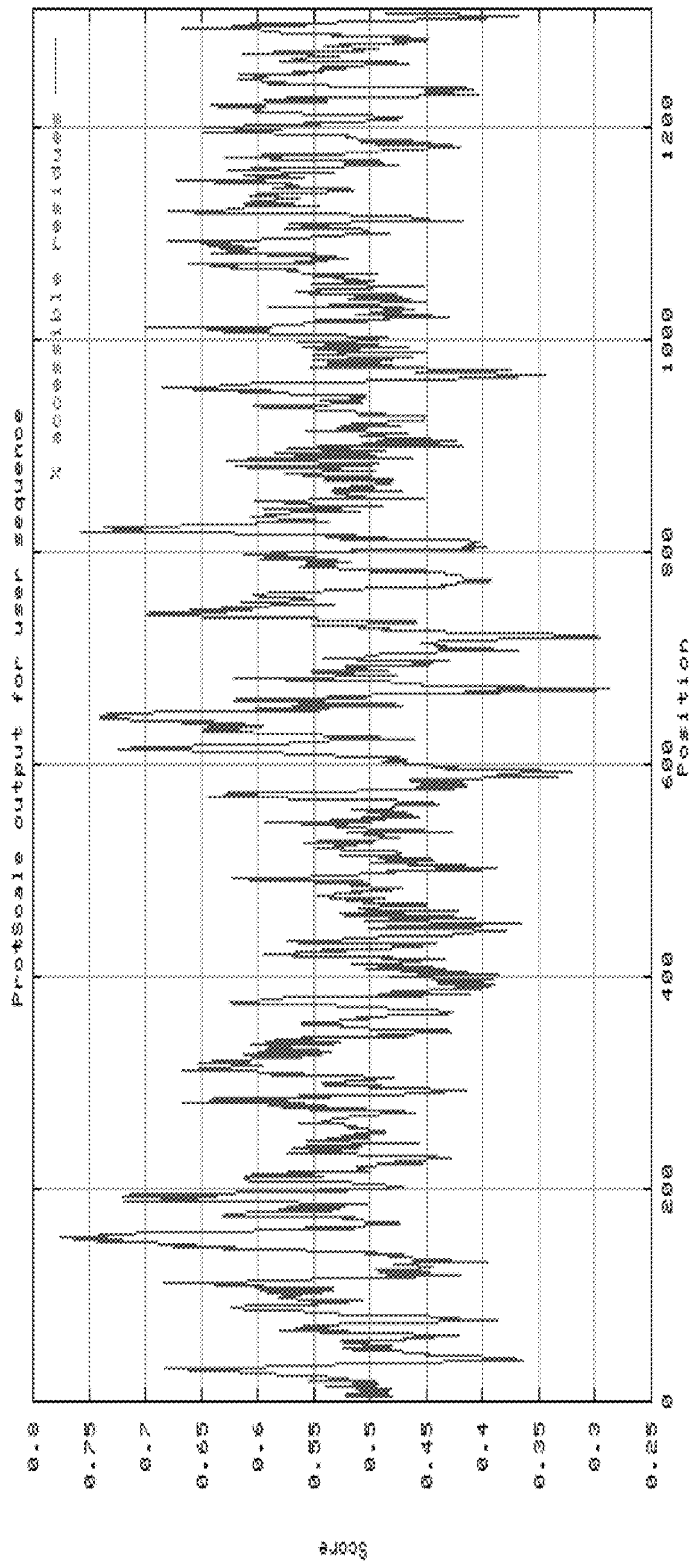

Figure 7R: 185P3C2 % Accessible Residues Profile
(Janin J., 1979, Nature 277:491-492)
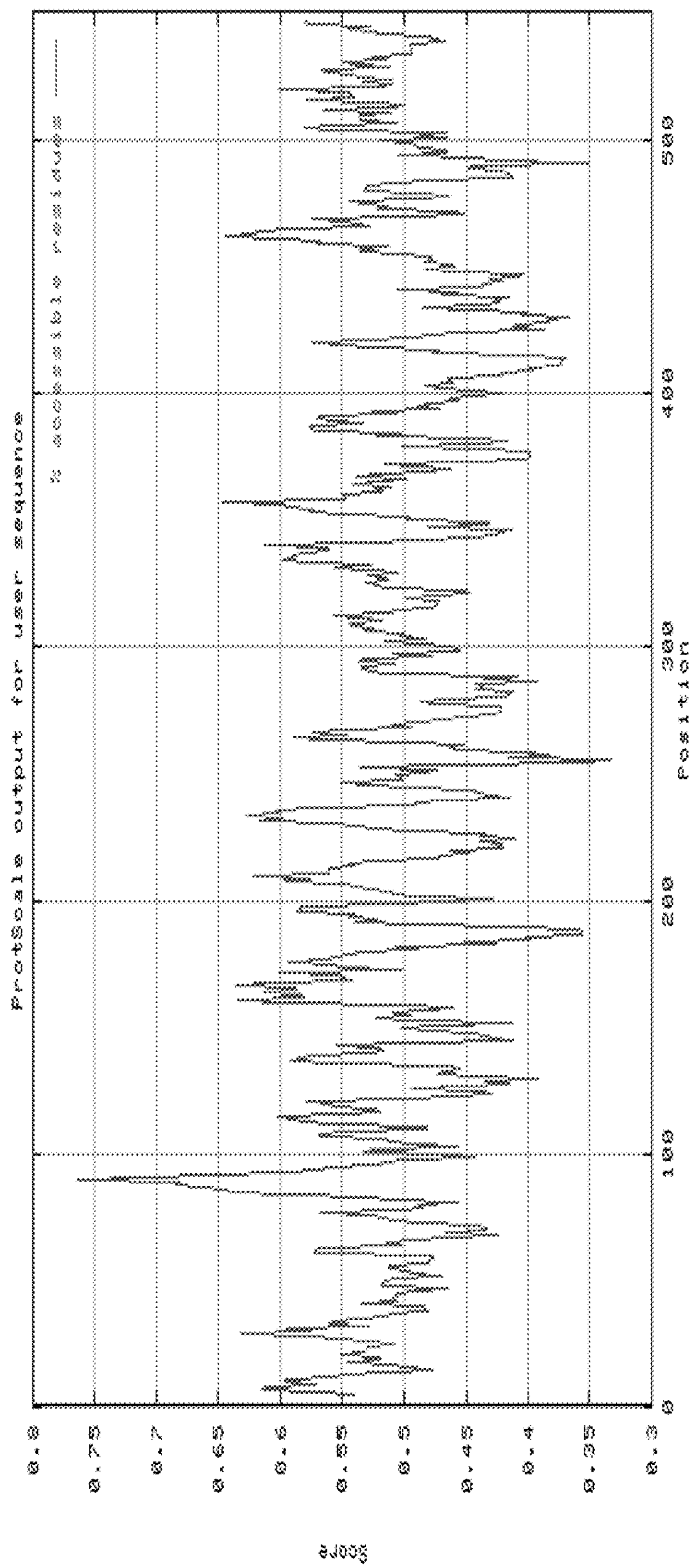

Figure 7S: 186P1H9 % Accessible Residues Profile
(Janin J., 1979, Nature 277:491-492)
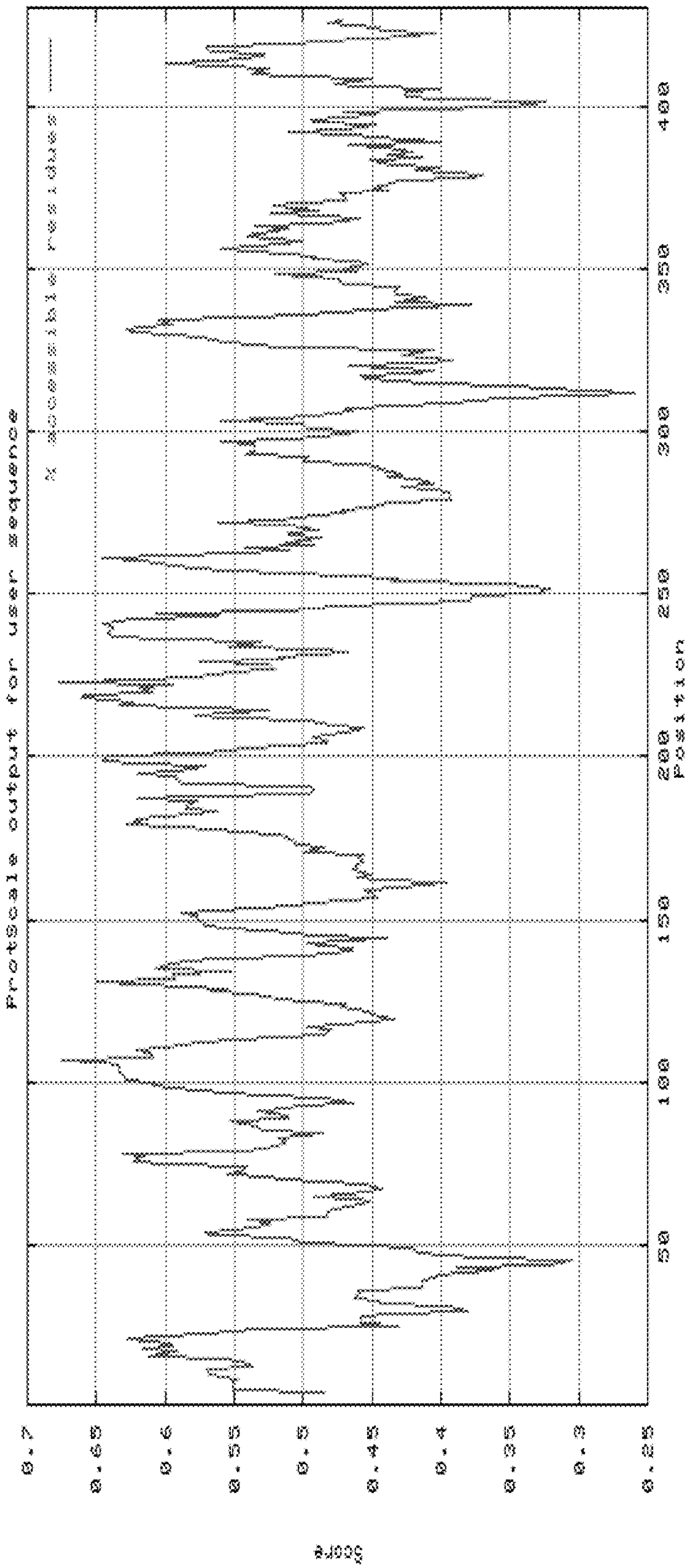

Figure 7T: 187P3F2 % Accessible Residues Profile
(Janin J., 1979. Nature 277:491-492)
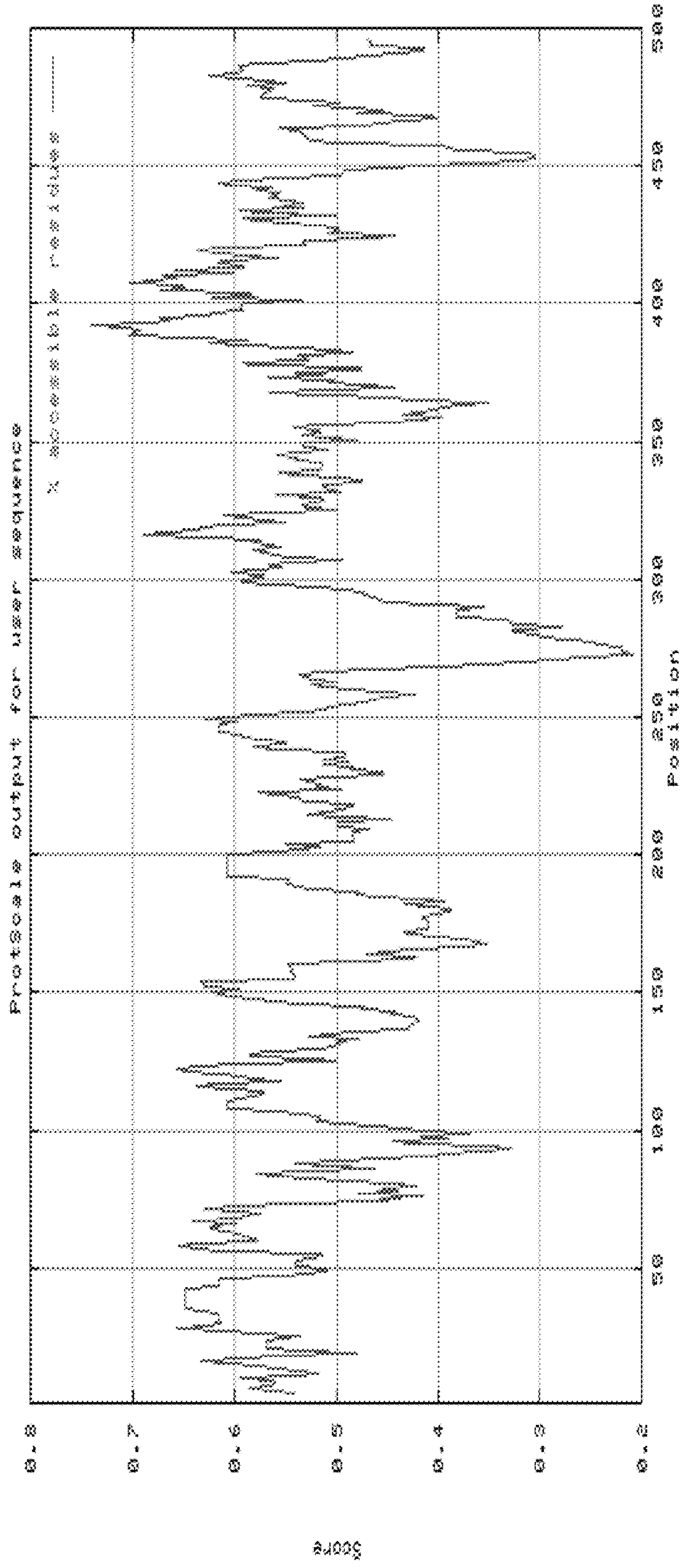

Figure 7U: 192P2G7 % Accessible Residues Profile
(Janin J., 1979. Nature 277:491-492)
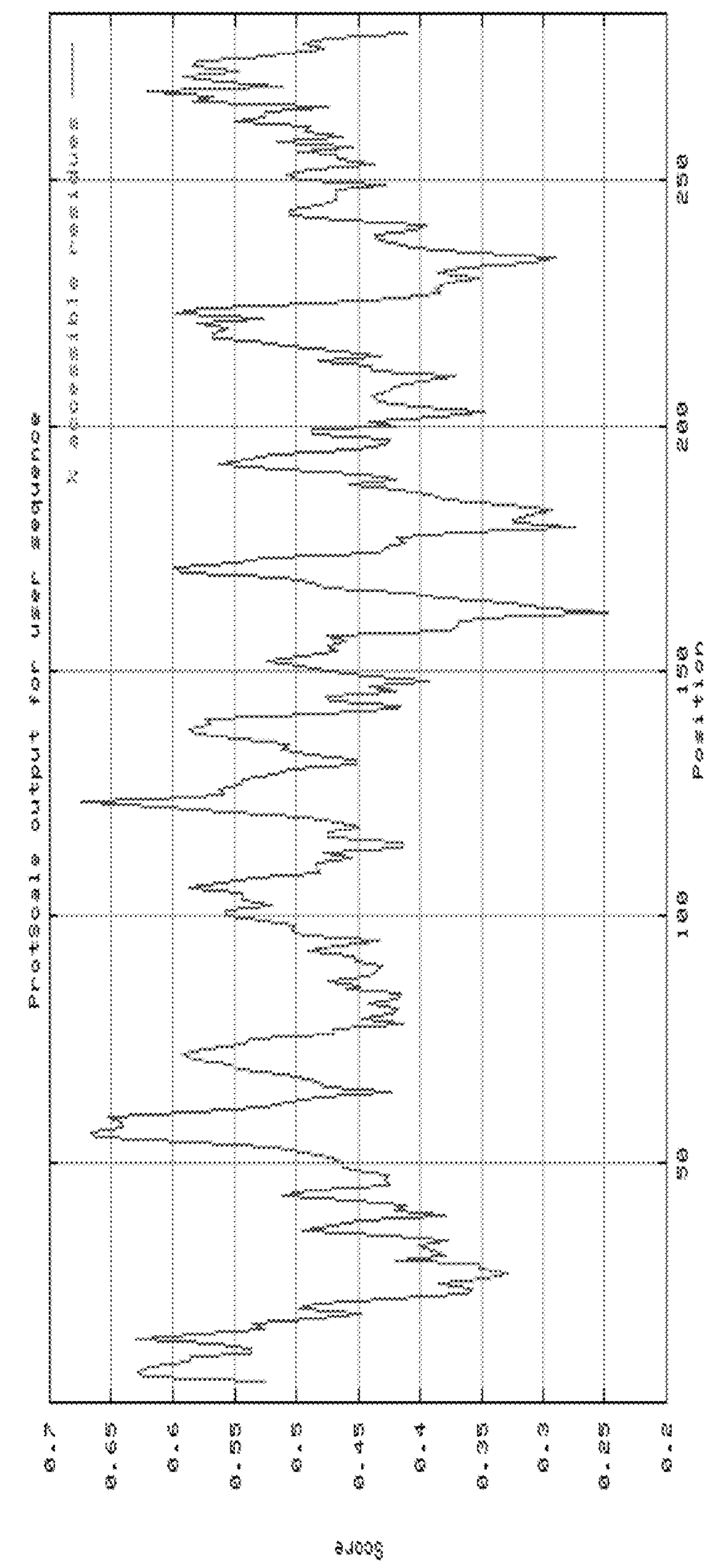

74P3B3 variant 1a Average Flexibility Profile
(Bhaskaran R., Ponnuswamy P.K., 1988.
Int. J. Pept. Protein Res. 32:242-255)

74P3B3 variant 1b Average Flexibility Profile
(Bhaskaran R., Ponnuswamy P.K., 1988,
Int. J. Pept. Protein Res. 32:242-255)

83P4B8 Average Flexibility Profile
(Bhaskaran R., Ponnuswamy P.K., 1988. Int. J. Pept. Protein Res. 32:242-255)

109P1D4 Average Flexibility Profile
(Bhaskaran R., Ponnuswamy P.K., 1988.
Int. J. Pept. Protein Res. 32:242-255)

Figure 8E: 151P4E11 Average Flexibility Profile
(Bhaskaran R., Ponnuswamy P.K., 1988.
Int. J. Pept. Protein Res. 32:242-255)
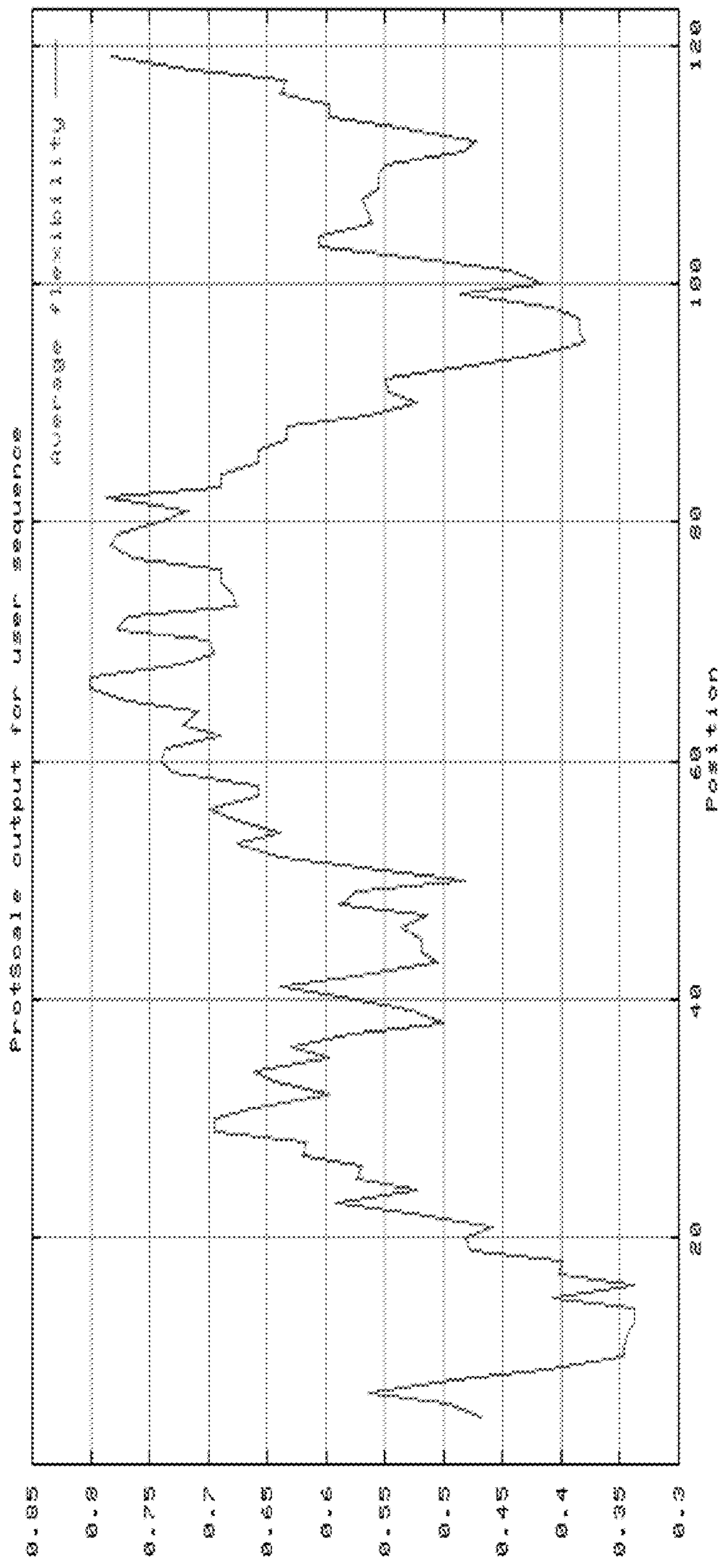

Figure 8F: 151P1C7a Average Flexibility Profile
(Bhaskaran R., Ponnuswamy P.K., 1988.
Int. J. Pept. Protein Res. 32:242-255)
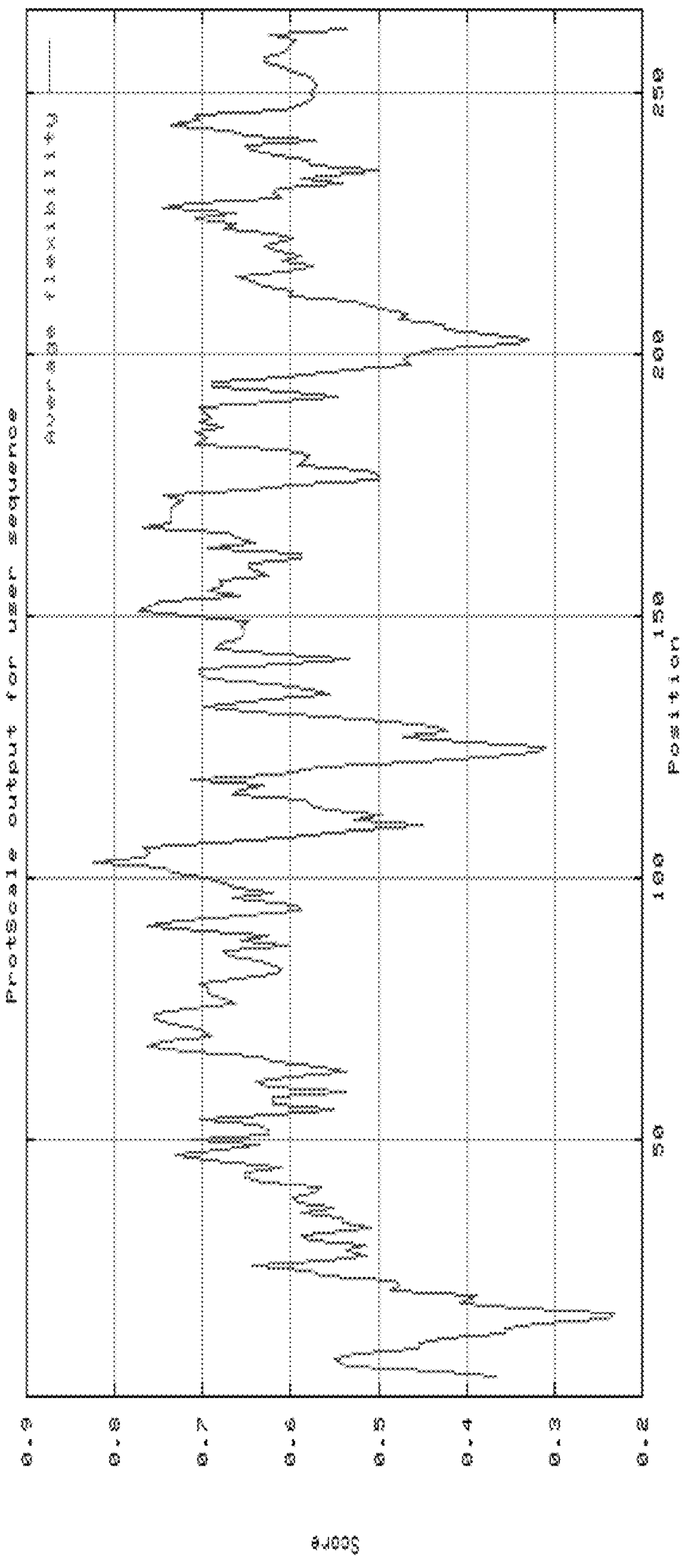

Figure 8G: 154P2A8 Average Flexibility Profile
(Bhaskaran R., Ponnuswamy P.K., 1988.
Int. J. Pept. Protein Res. 32:242-255)
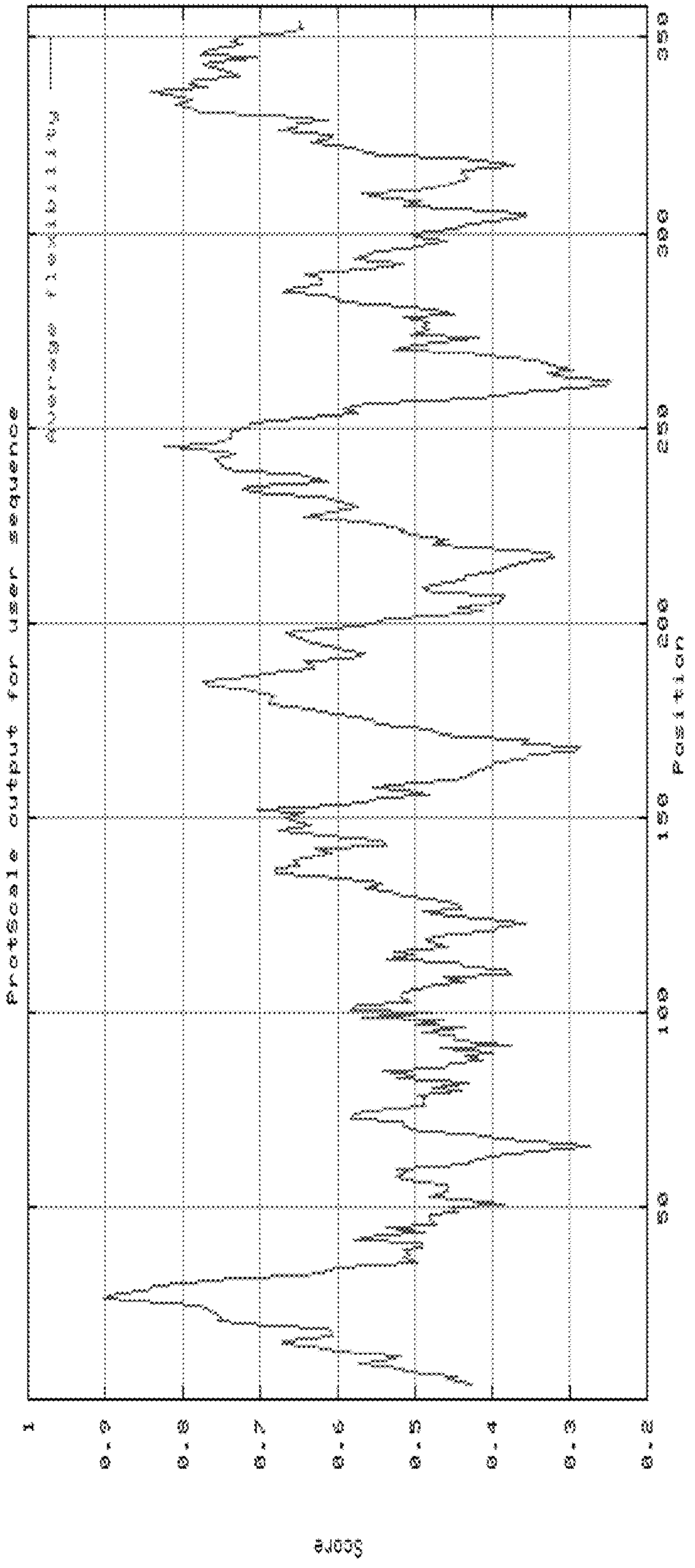

Figure 8H: 156P1D4 Average Flexibility Profile
(Bhaskaran R., Ponnuswamy P.K., 1988.
Int. J. Pept. Protein Res. 32:242-255)
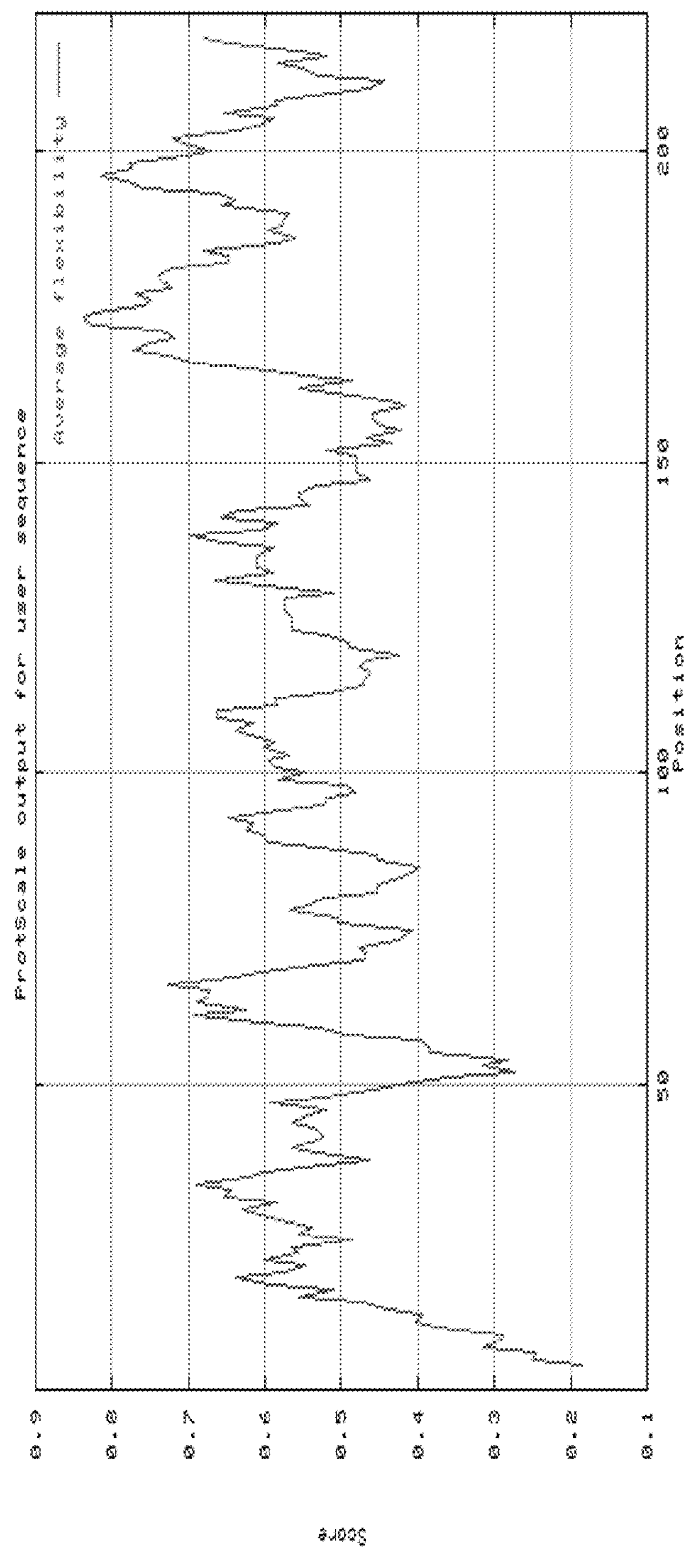

Figure 8I: 156P5C12 Average Flexibility Profile
(Bhaskaran R., Ponnuswamy P.K., 1988.
Int. J. Pept. Protein Res. 32:242-255)
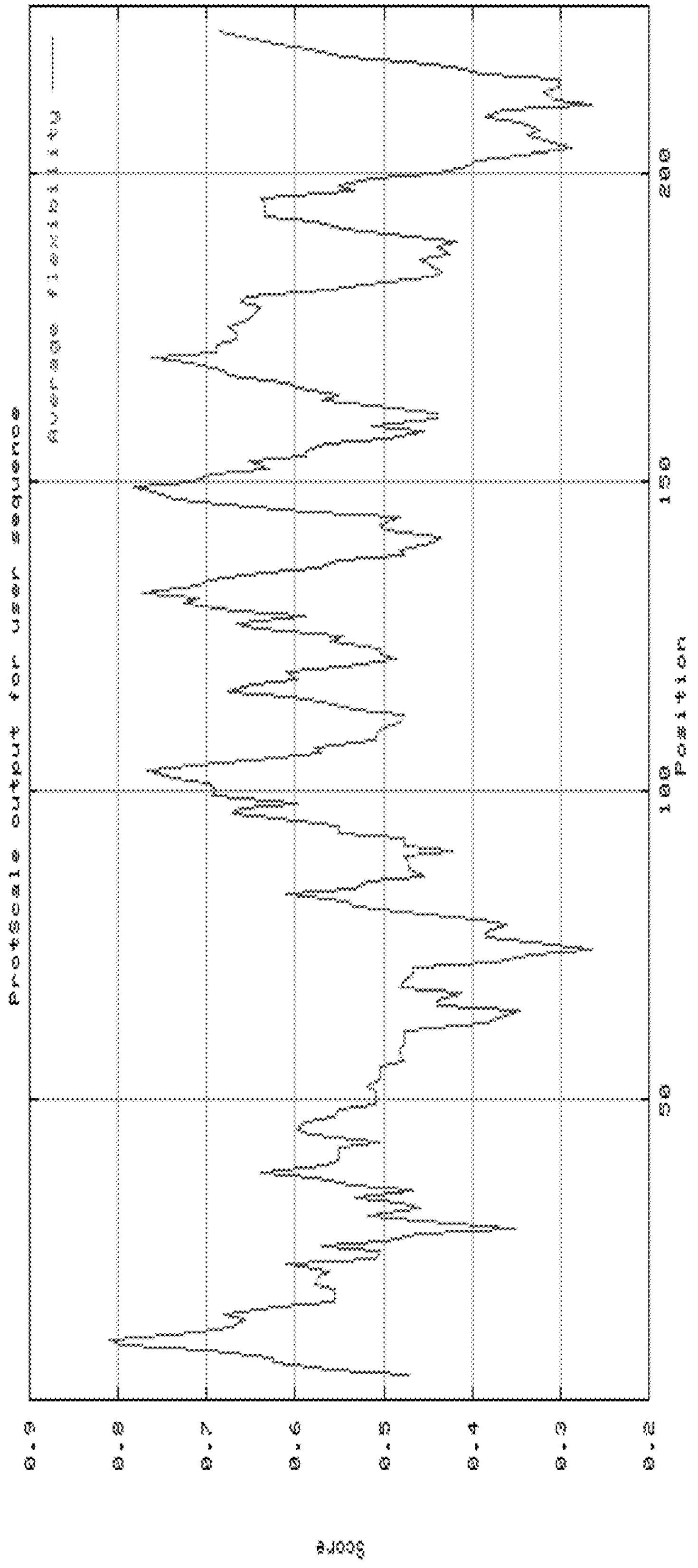

Figure 8J: 159P2B5 Average Flexibility Profile
(Bhaskaran R., Ponnuswamy P.K., 1988.
Int. J. Pept. Protein Res. 32:242-255)
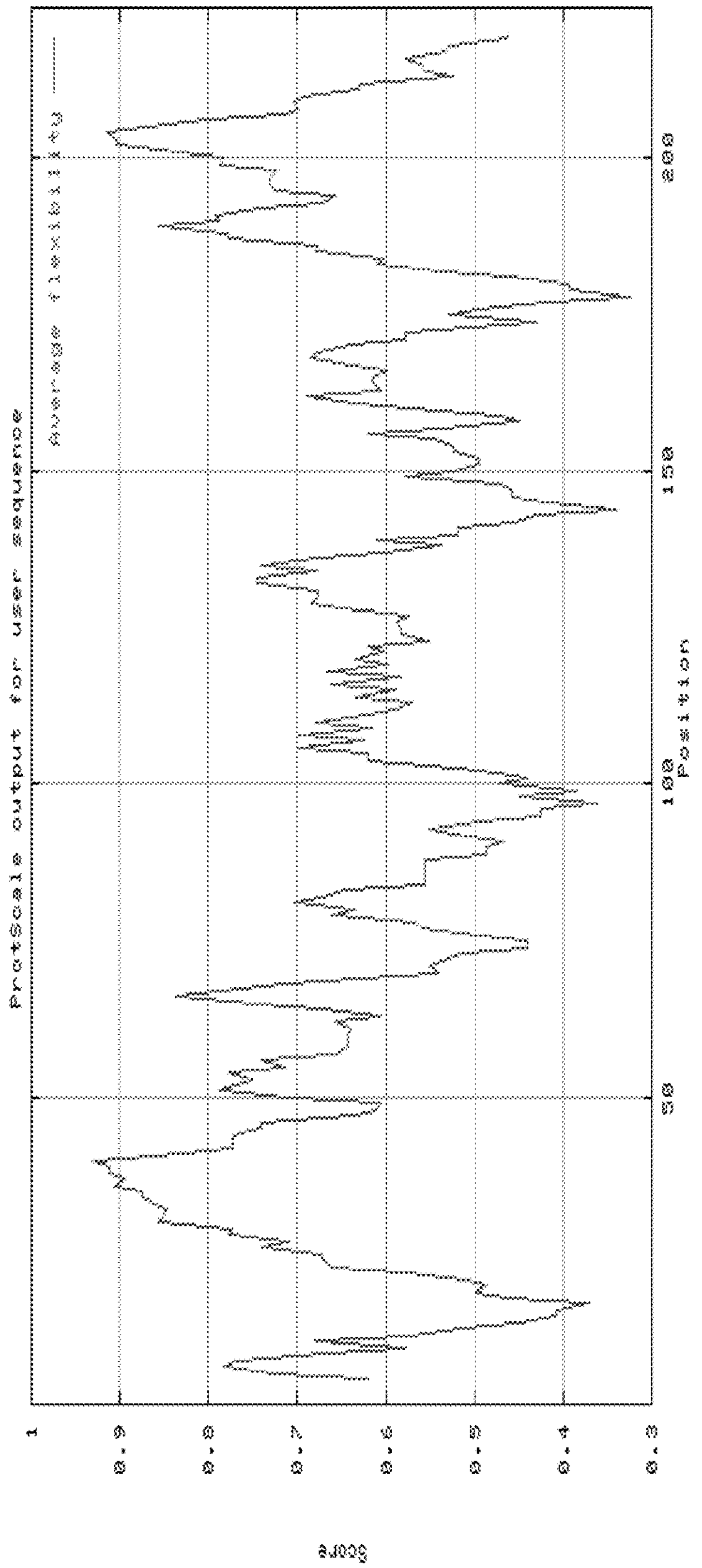

Figure 8K: 161P2B7a Average Flexibility Profile
(Bhaskaran R., Ponnuswamy P.K., 1988.
Int. J. Pept. Protein Res. 32:242-255)
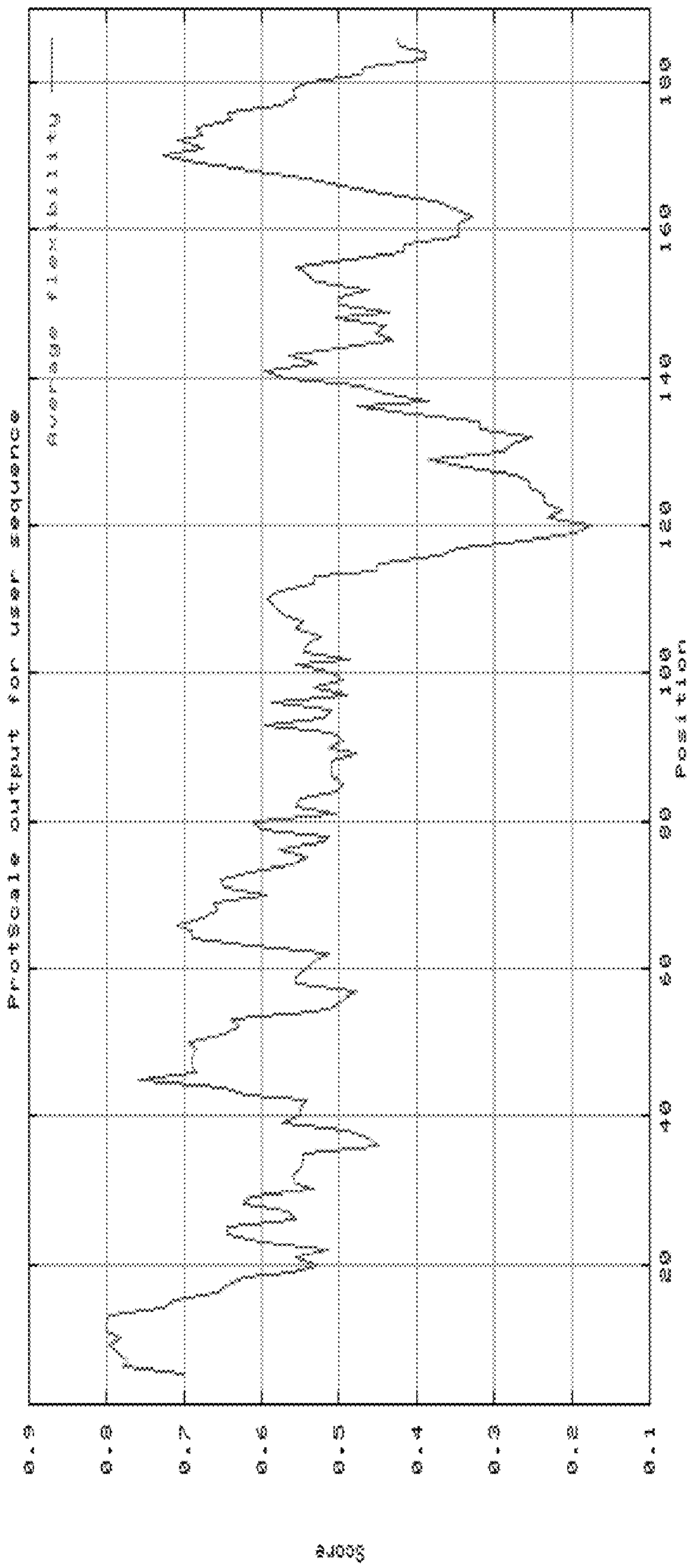

Figure 8L: 179P3G7 Average Flexibility Profile
(Bhaskaran R., Ponnuswamy P.K., 1988.
Int. J. Pept. Protein Res. 32:242-255)
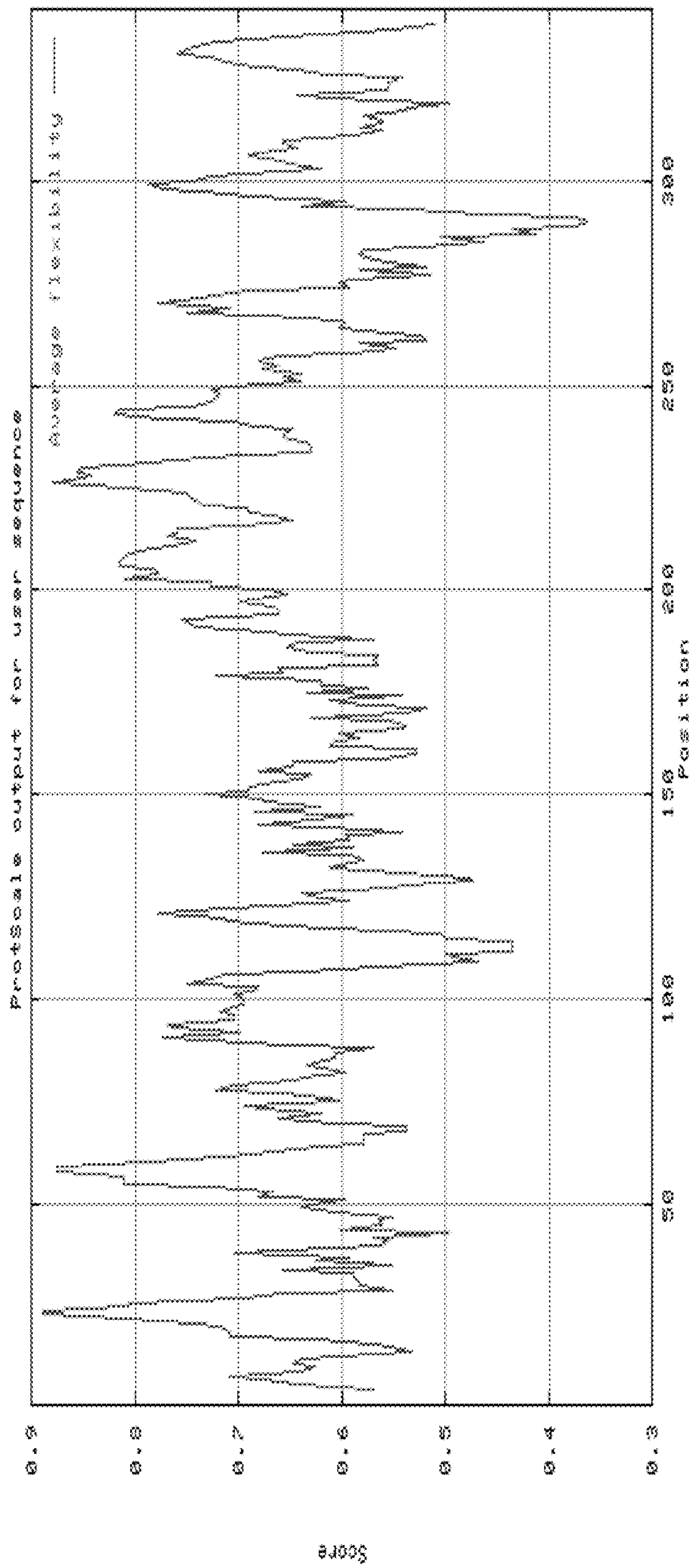

Figure 8M: 184P3C10b Average Flexibility Profile
(Bhaskaran R., Ponnuswamy P.K., 1988.
Int. J. Pept. Protein Res. 32:242-255)
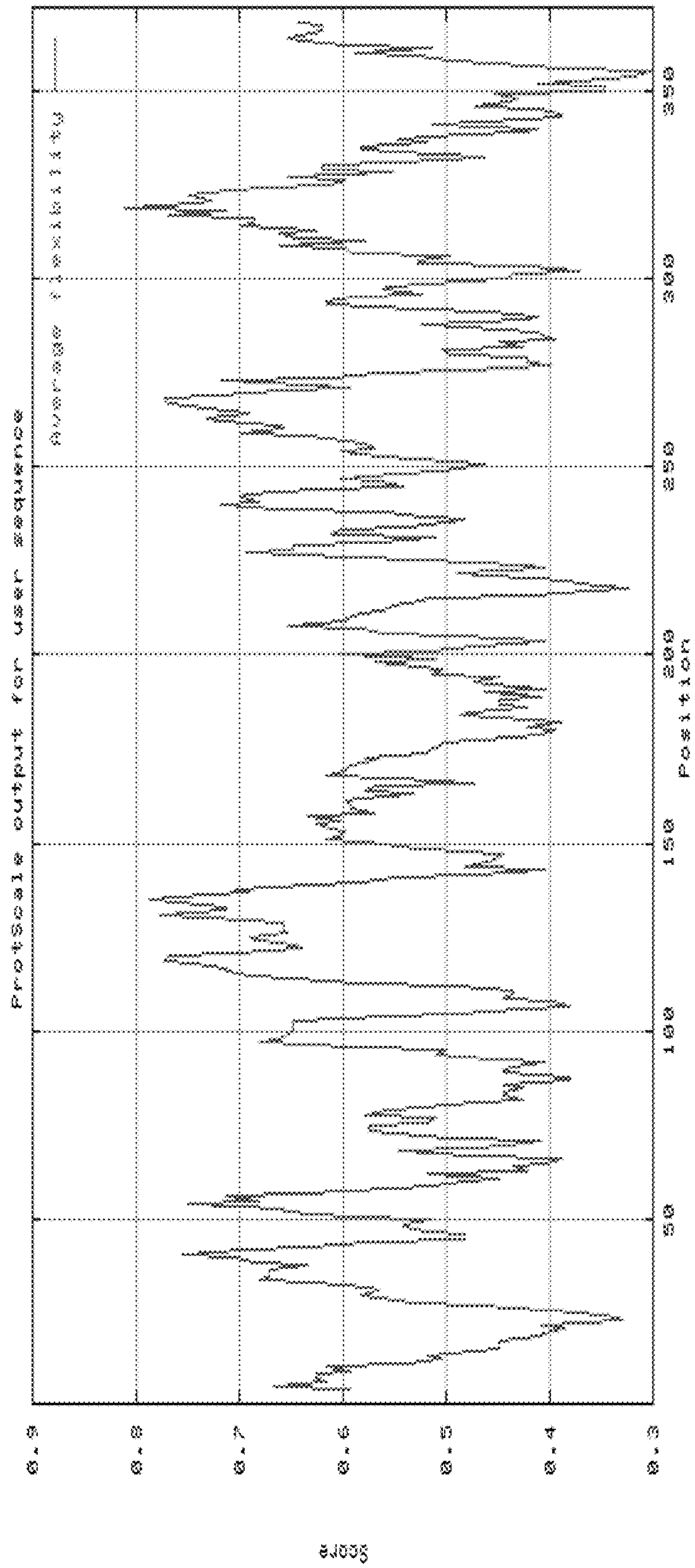

Figure 8N: 184P3G10 Average Flexibility Profile
(Bhaskaran R., Ponnuswamy P.K., 1988.
Int. J. Pept. Protein Res. 32:242-255)
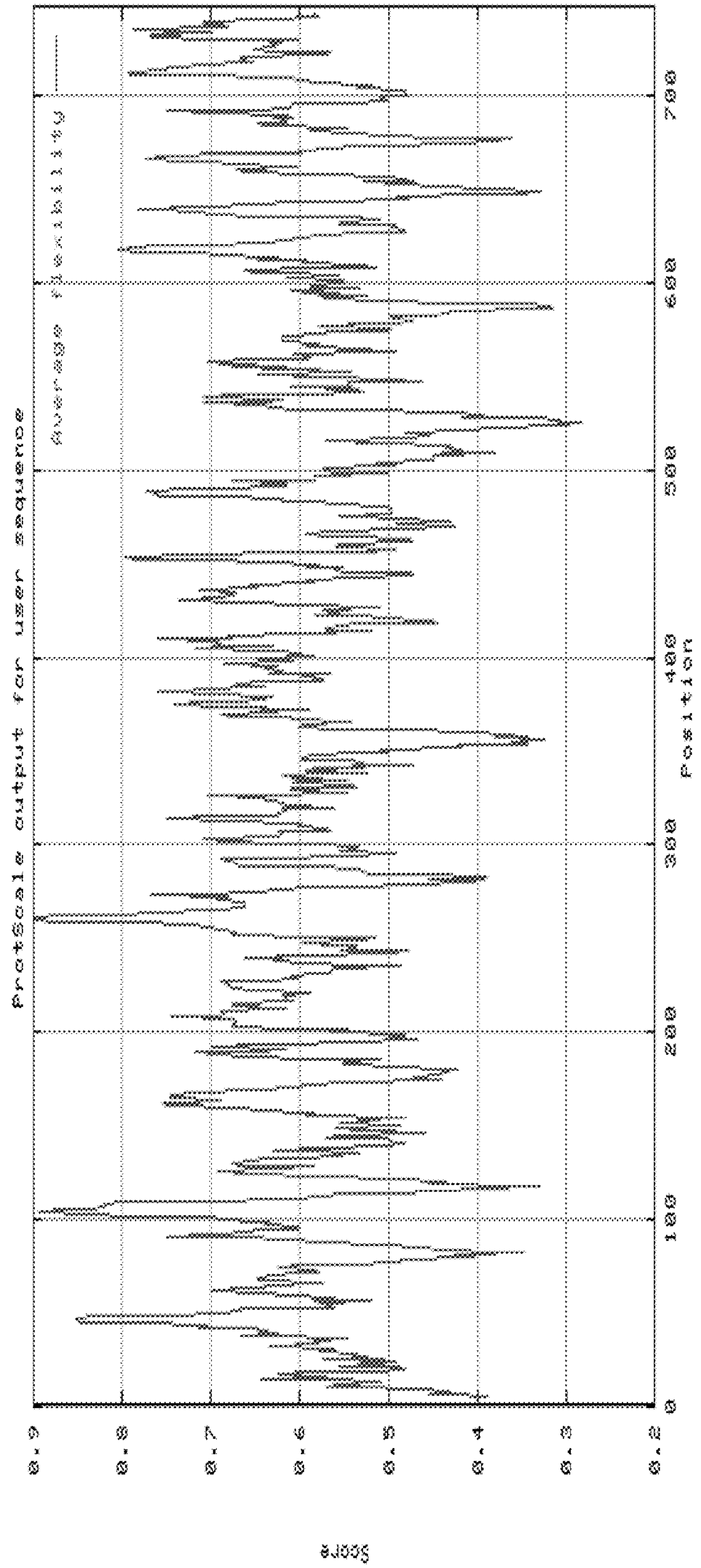

Figure 8O: 185P2C9 variant 1 Average Flexibility Profile
(Bhaskaran R., Ponnuswamy P.K., 1988.
Int. J. Pept. Protein Res. 32:242-255)
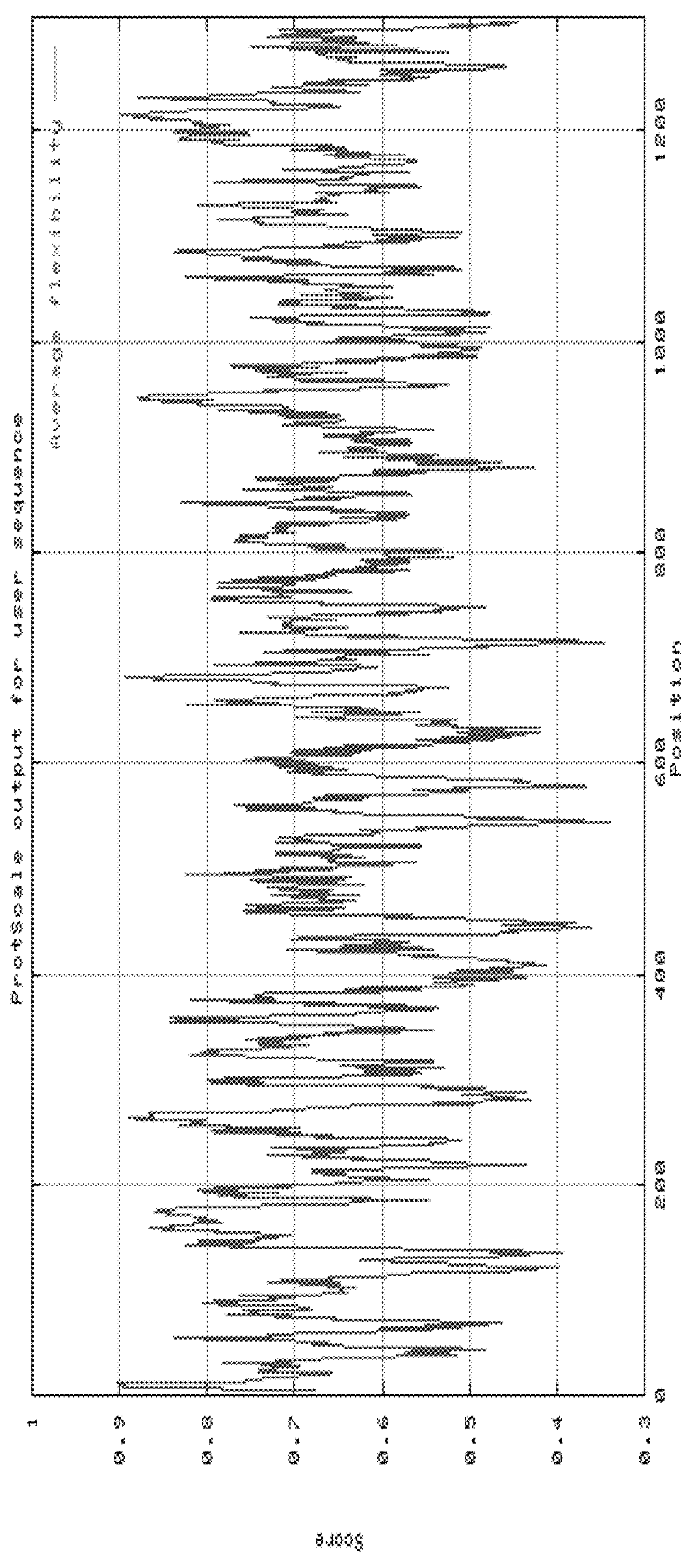

Figure 8P: 185P2C9 variant 2 Average Flexibility Profile
(Bhaskaran R., Ponnuswamy P.K., 1988.
Int. J. Pept. Protein Res. 32:242-255)
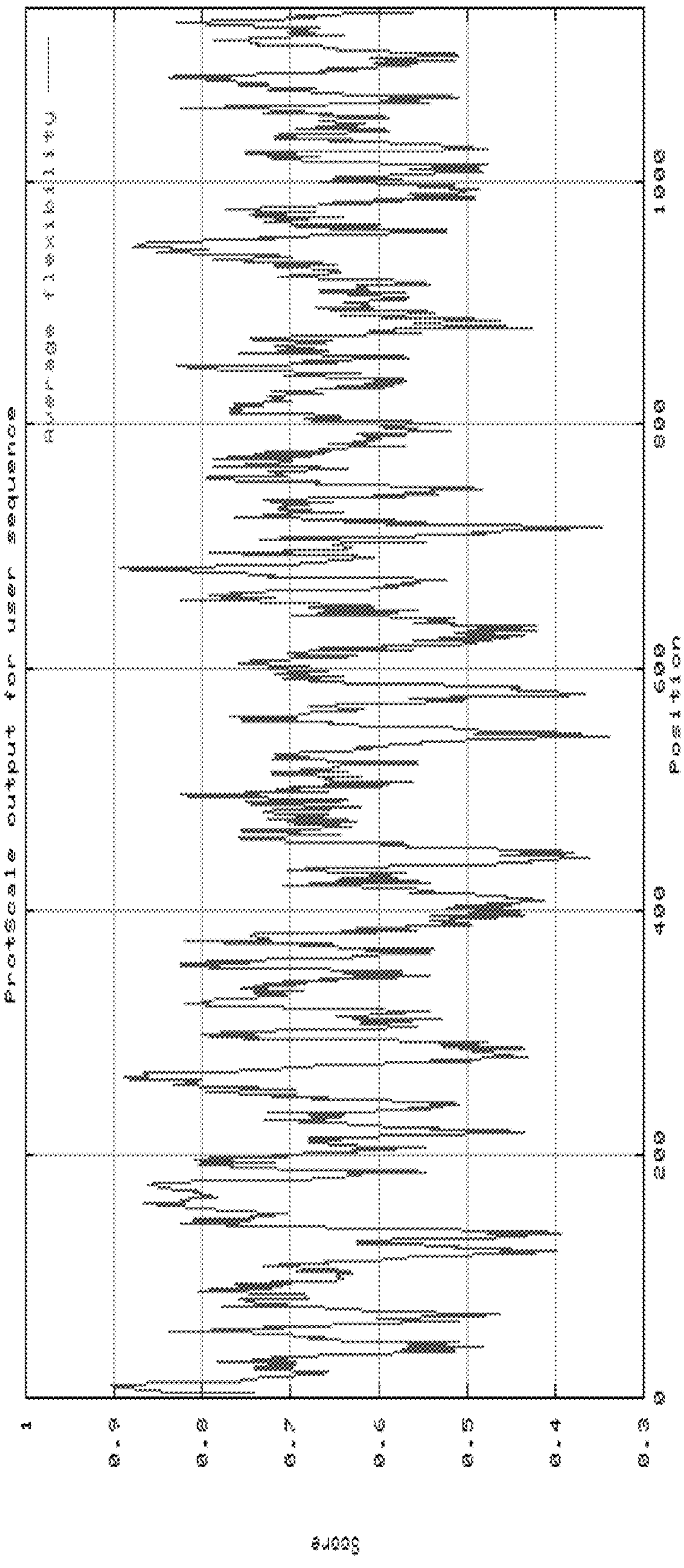

Figure 8Q: 185P2C9 variant 3 Average Flexibility Profile
(Bhaskaran R., Ponnuswamy P.K., 1988.
Int. J. Pept. Protein Res. 32:242-255)
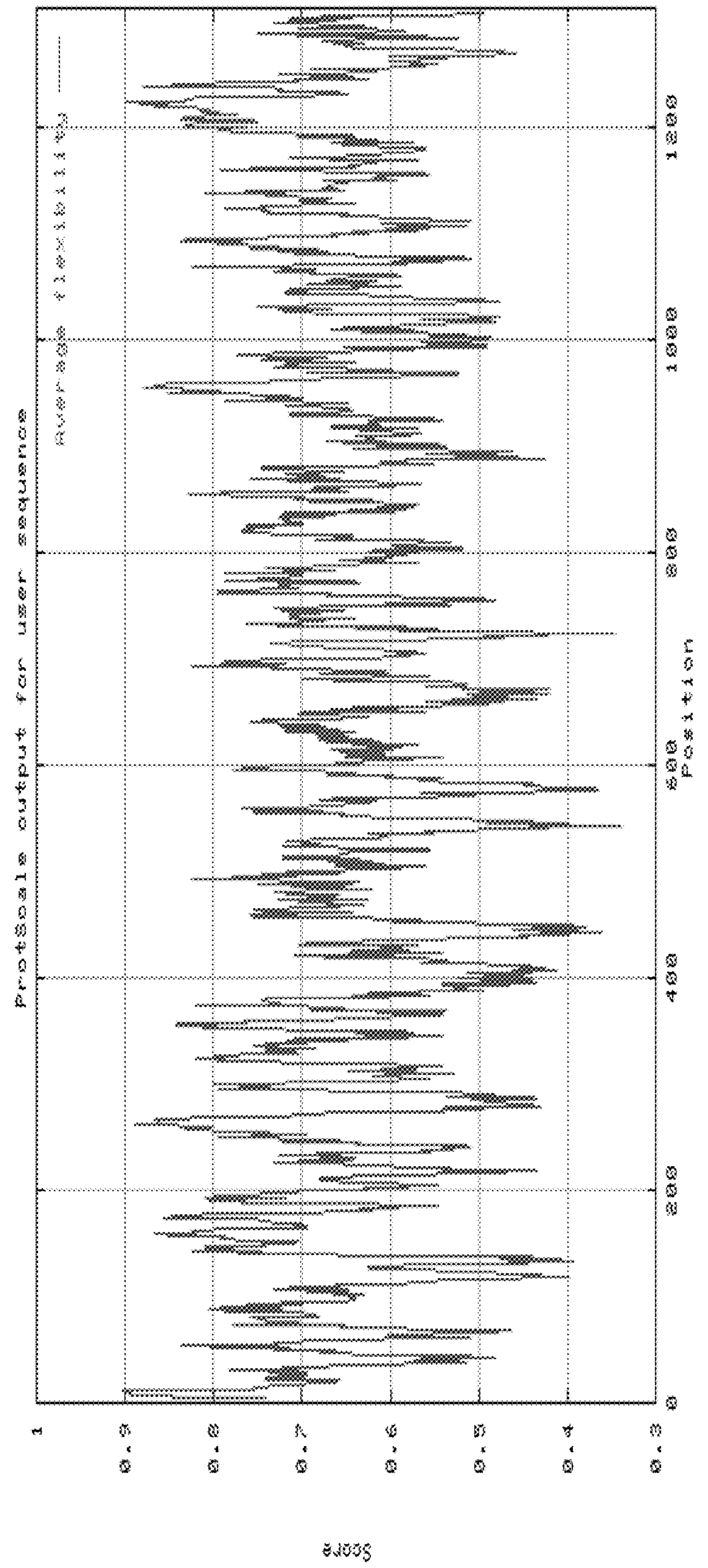

Figure 8R: 185P3C2 Average Flexibility Profile
(Bhaskaran R., Ponnuswamy P.K., 1988.
Int. J. Pept. Protein Res. 32:242-255)
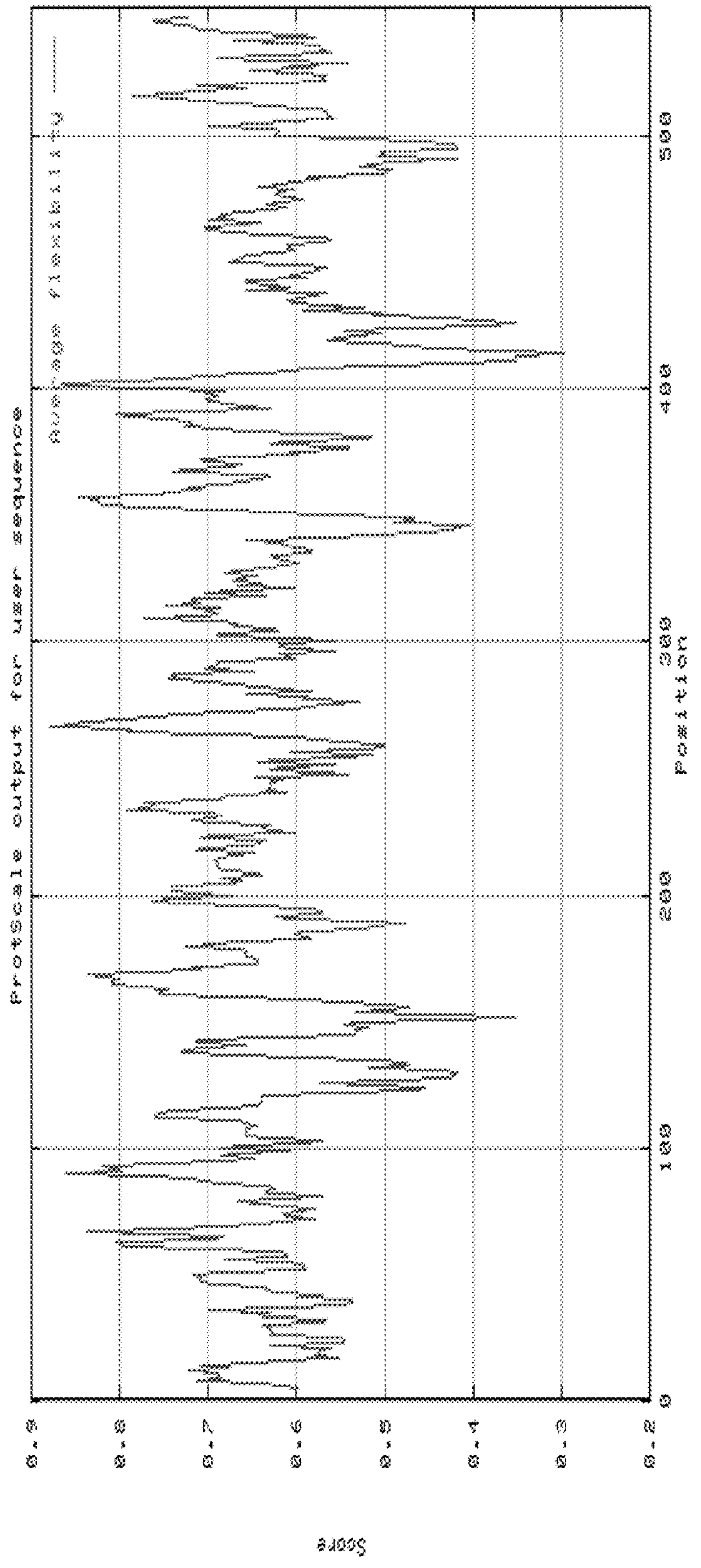

Figure 8S: 186P1H9 Average Flexibility Profile
(Bhaskaran R., Ponnuswamy P.K., 1988.
Int. J. Pept. Protein Res. 32:242-255)
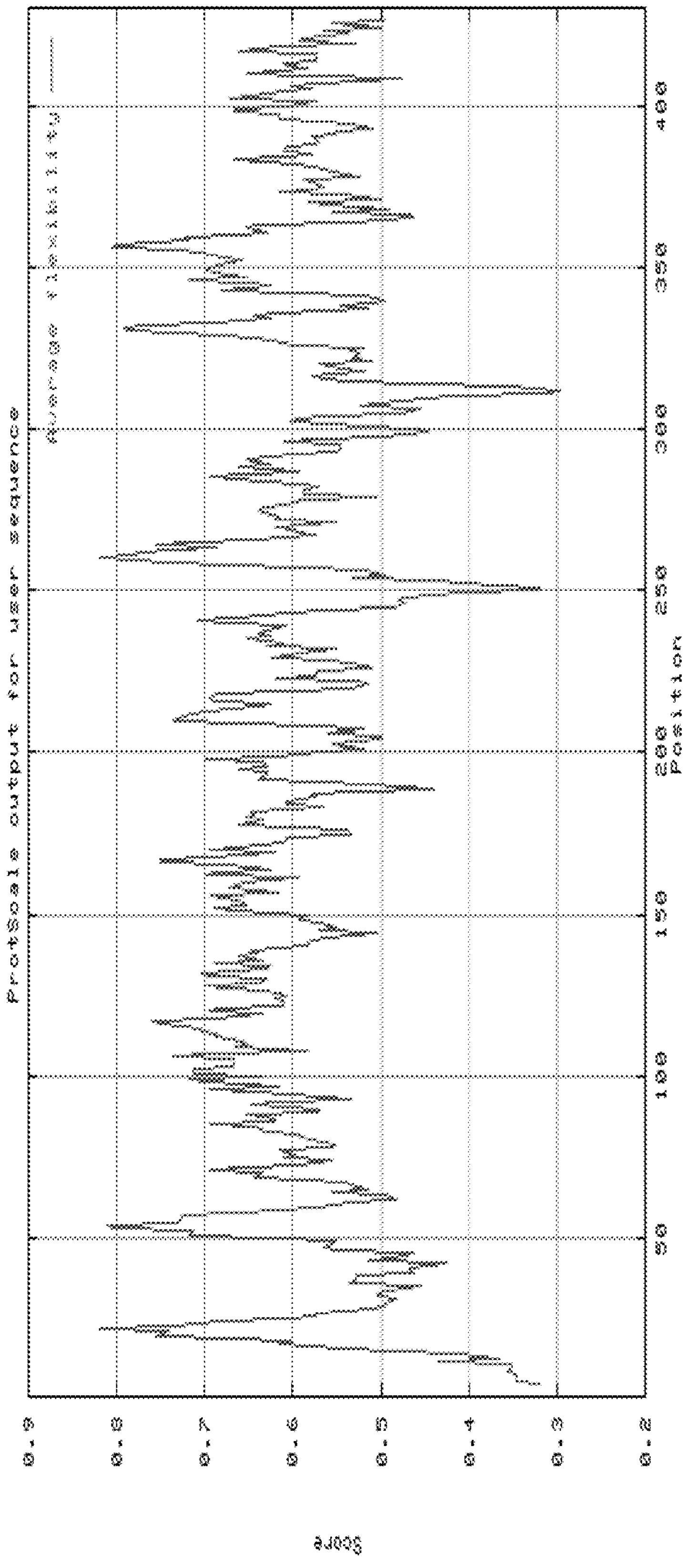

Figure 8T: 187P3F2 Average Flexibility Profile
(Bhaskaran R., Ponnuswamy P.K., 1988.
Int. J. Pept. Protein Res. 32:242-255)
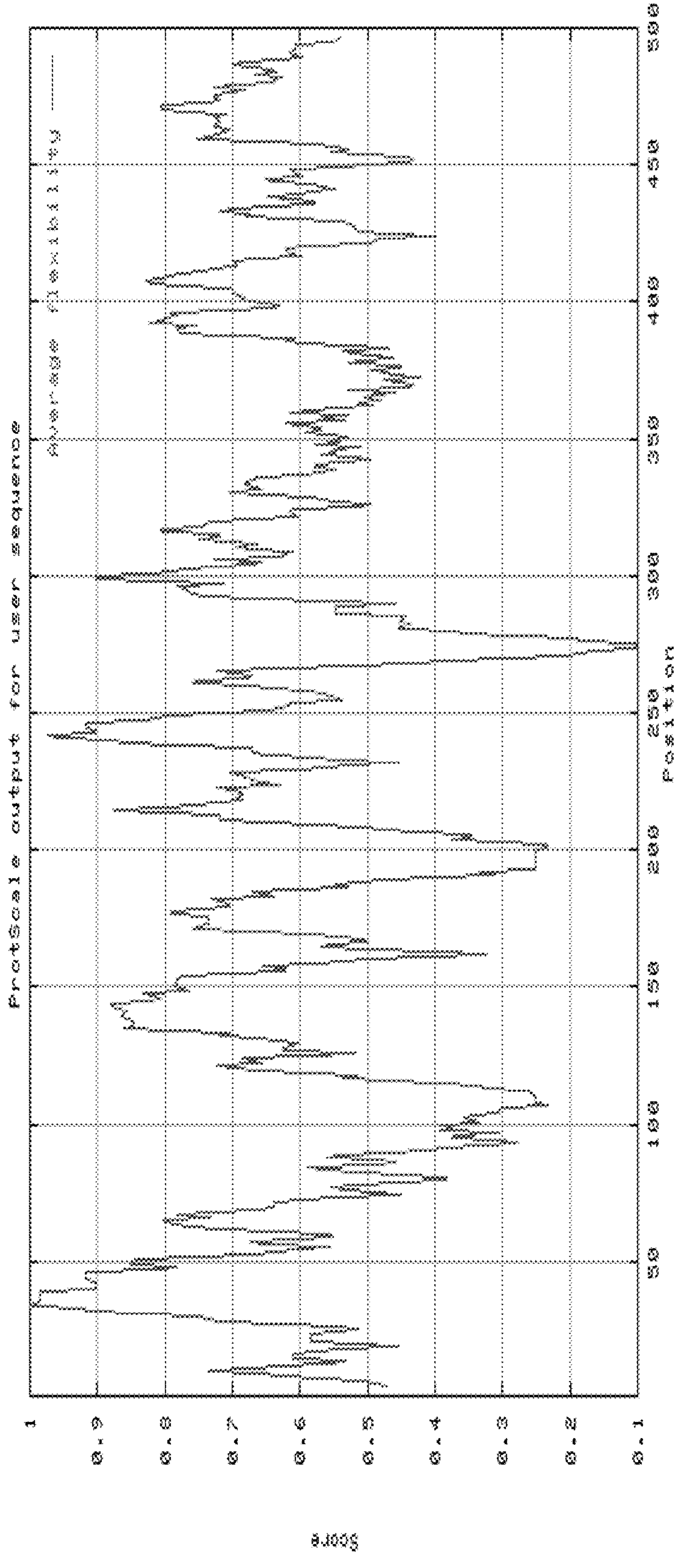

Figure 8U: 192P2G7 Average Flexibility Profile
(Bhaskaran R., Ponnuswamy P.K., 1988.
Int. J. Pept. Protein Res. 32:242-255)
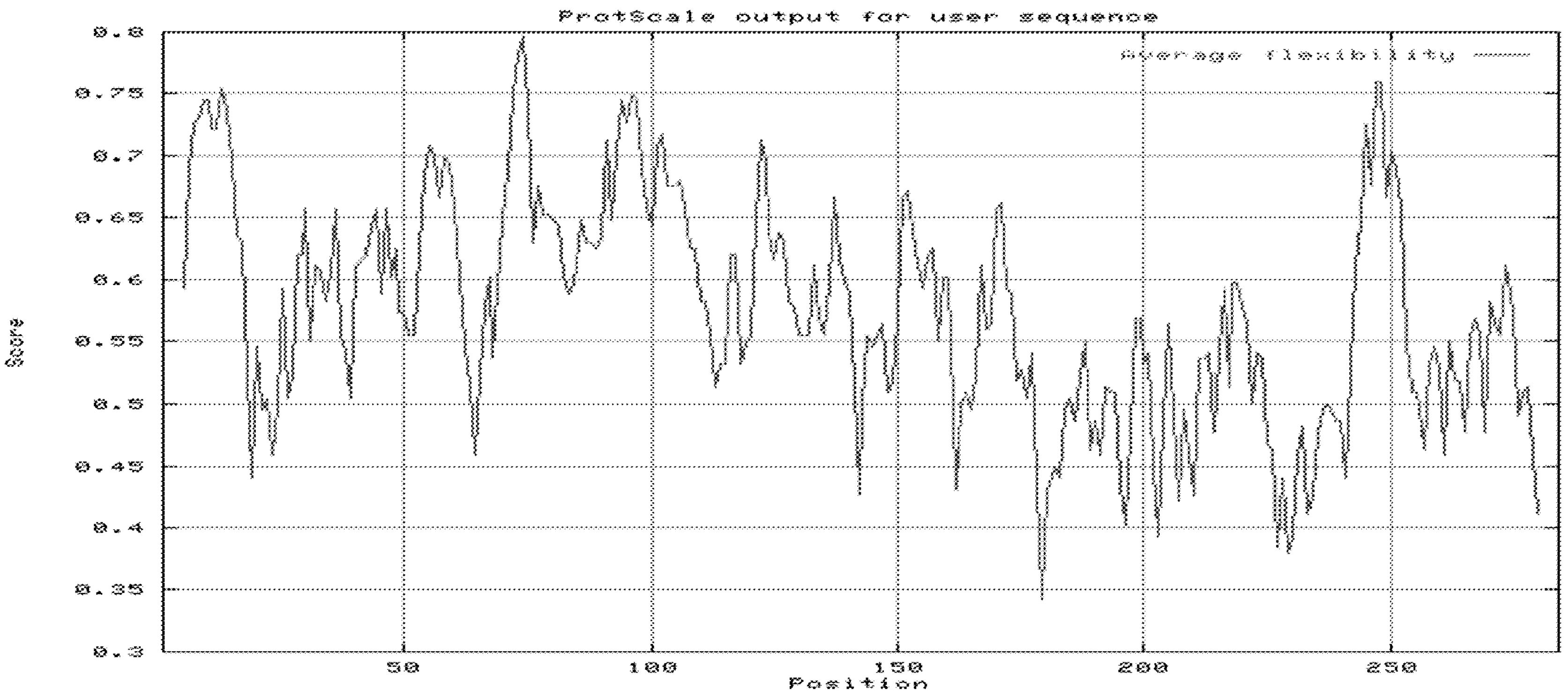

74P3B3 variant 1a Beta-turn Profile
(Deleage, G., Roux B. 1987. Protein Engineering 1:289-294)

74P3B3 variant 1b Beta-turn Profile (Deleage, G., Roux B. 1987. Protein Engineering 1:289-294)

83P4B8 Beta-turn Profile
(Deleage, G., Roux B. 1987. Protein Engineering 1:289-294)

109P1D4 Beta-turn Profile
(Deleage, G., Roux B. 1987. Protein Engineering 1:289-294)

Figure 9E: 151P4E11 Beta-turn Profile
(Deleage, G., Roux B. 1987. Protein Engineering 1:289-294)
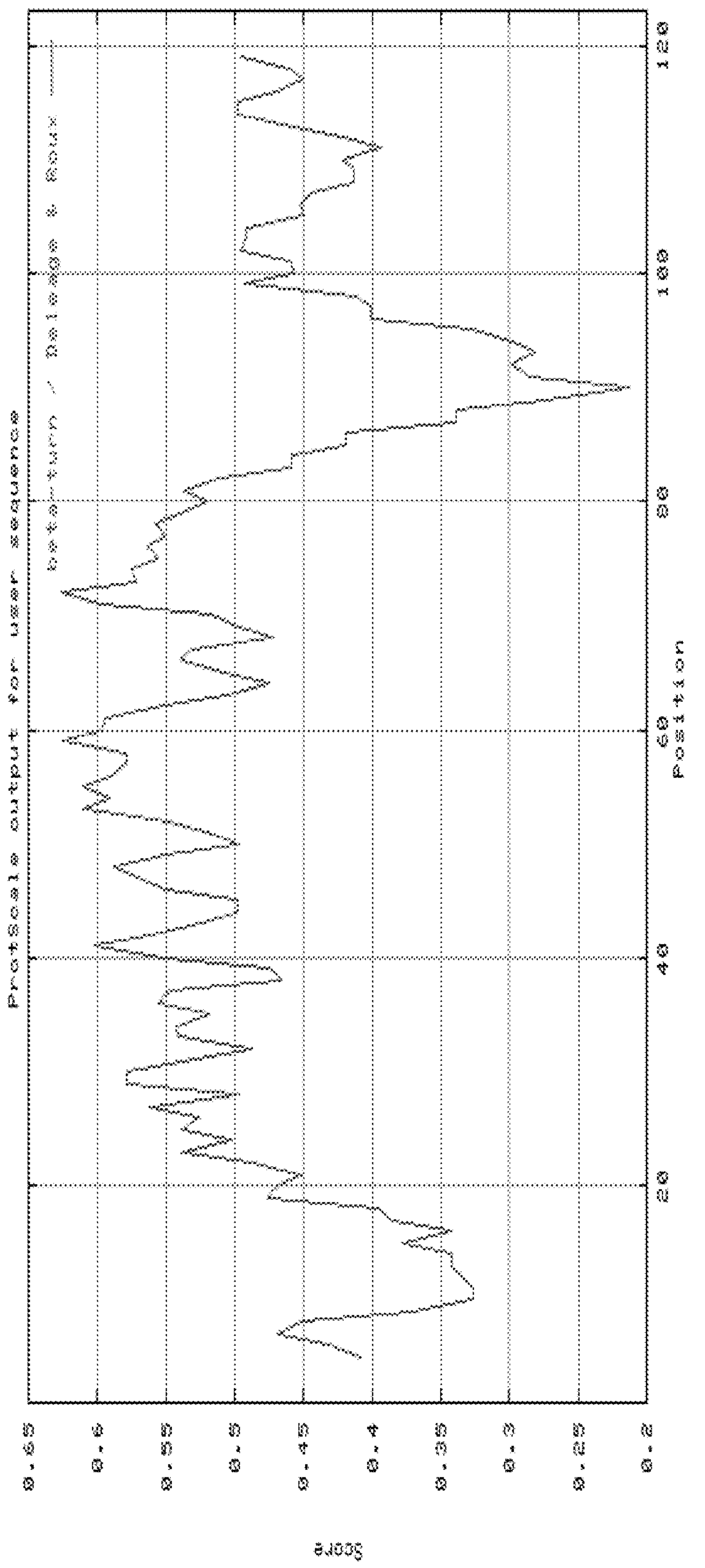

Figure 9F: 151P1C7a Beta-turn Profile
(Deleage, G., Roux B. 1987. Protein Engineering 1:289-294)
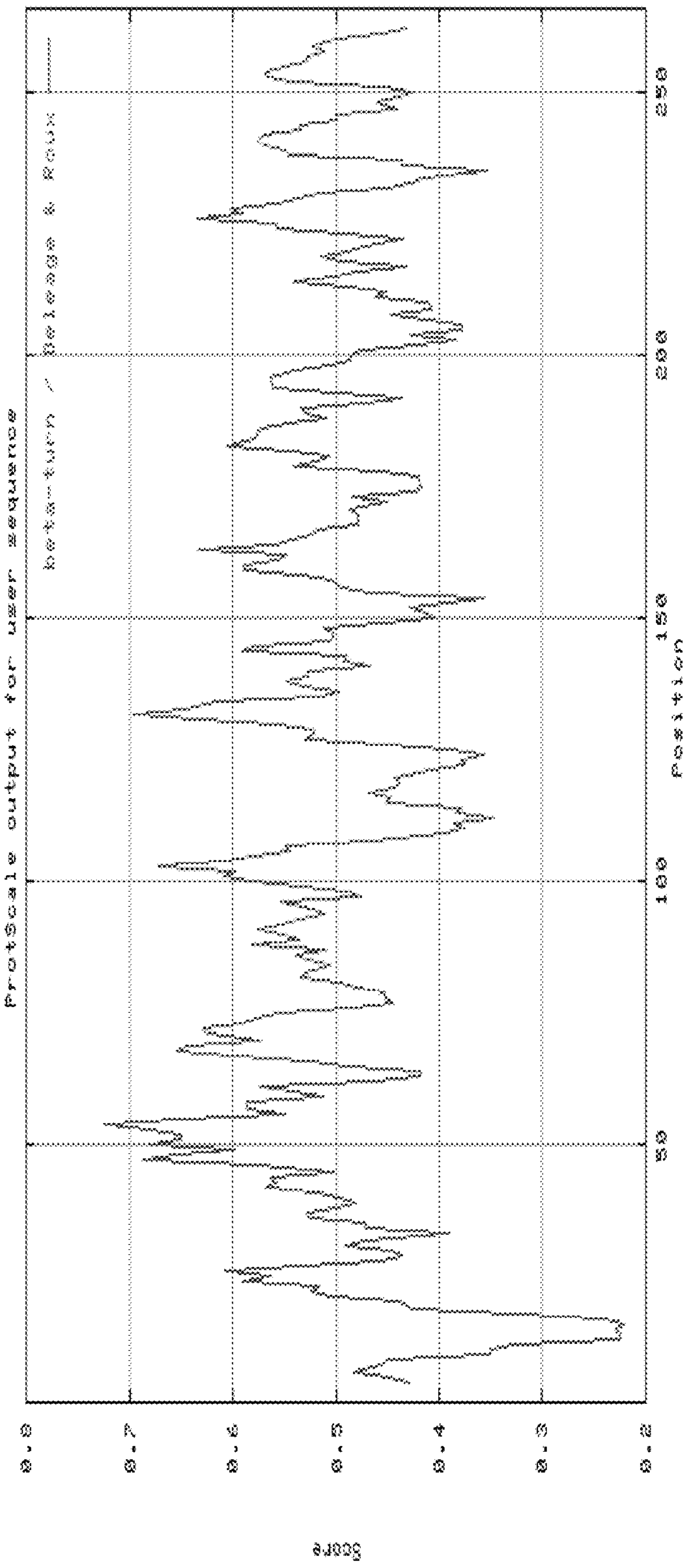

Figure 9G: 154P2A8 Beta-turn Profile
(Deleage, G., Roux B. 1987. Protein Engineering 1:289-294)
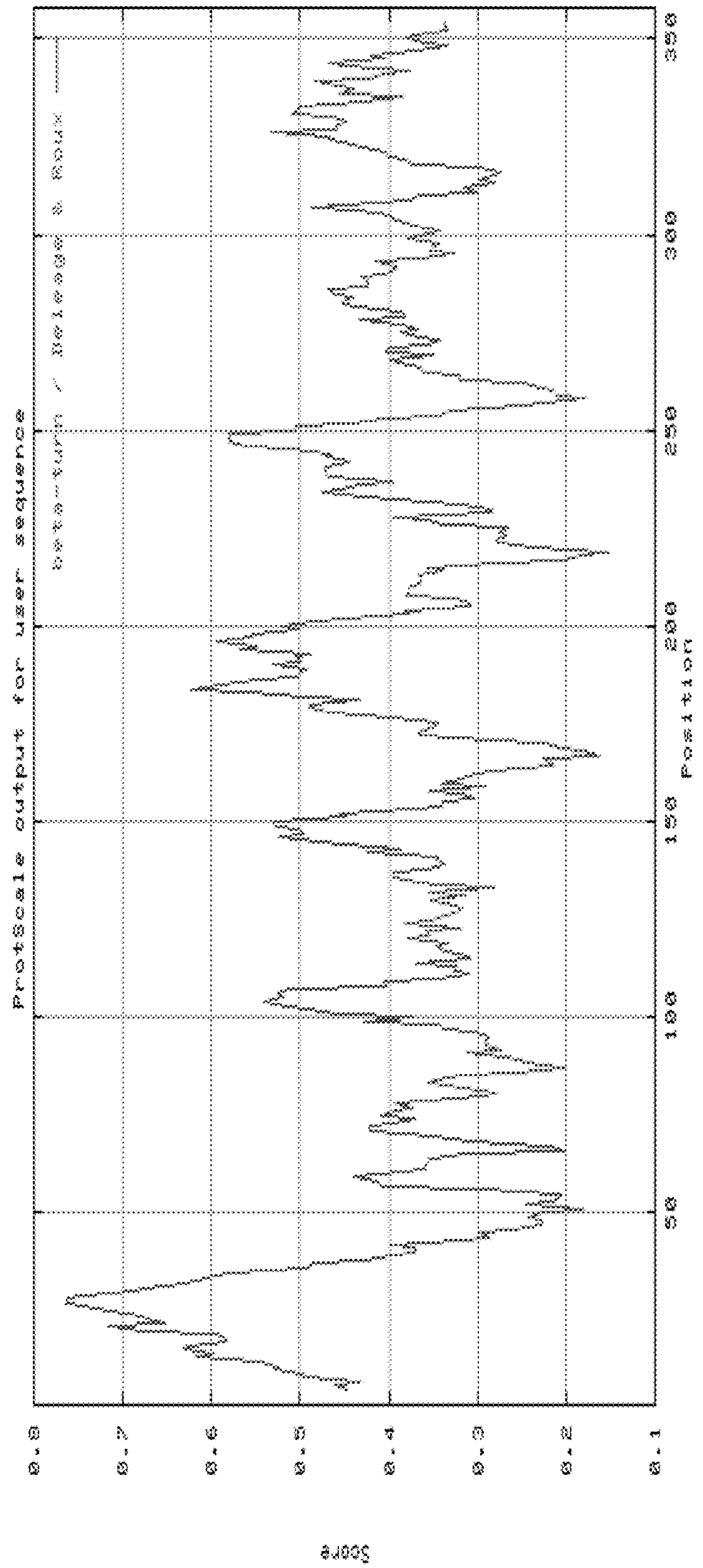

Figure 9H: 156P1D4 Beta-turn Profile
(Deleage, G., Roux B. 1987. Protein Engineering 1:289-294)
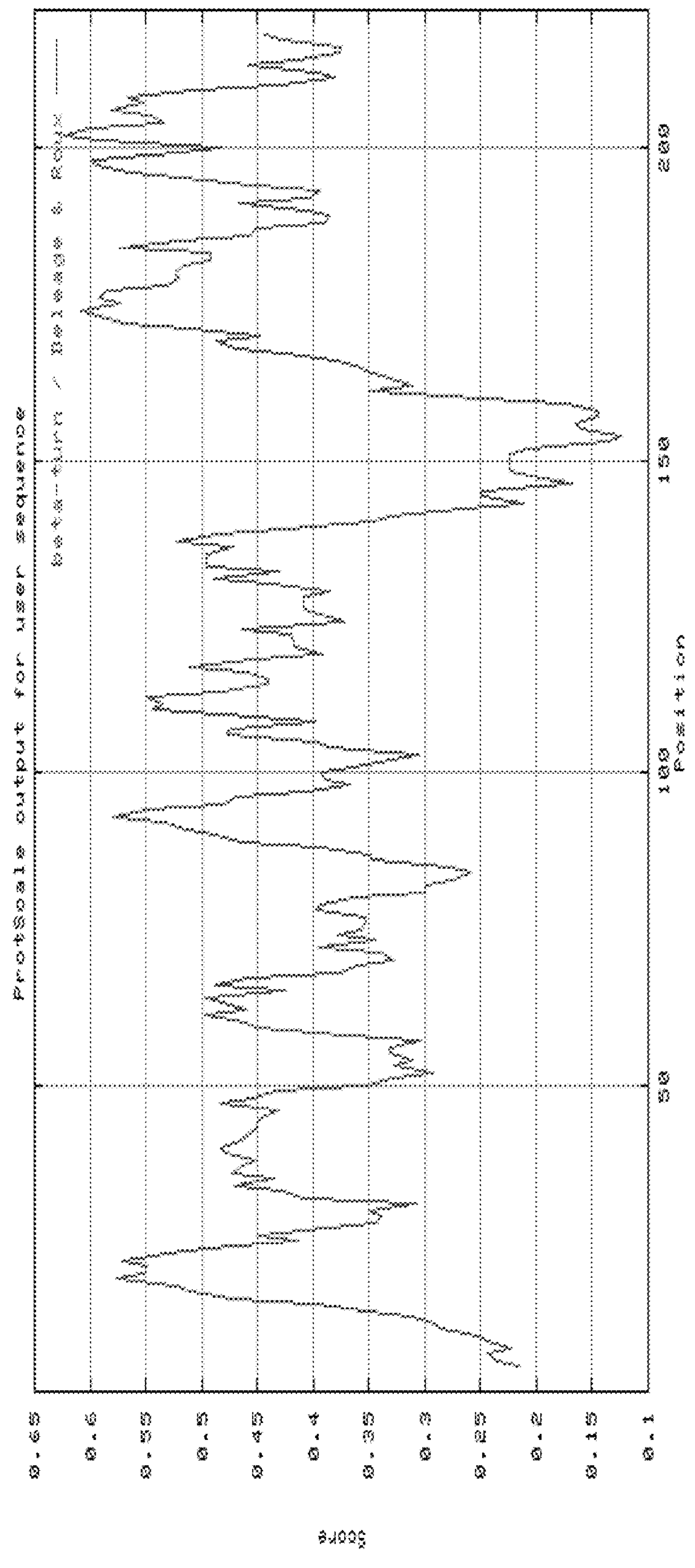

Figure 9I: 156P5C12 Beta-turn Profile
(Deleage, G., Roux B. 1987. Protein Engineering 1:289-294)
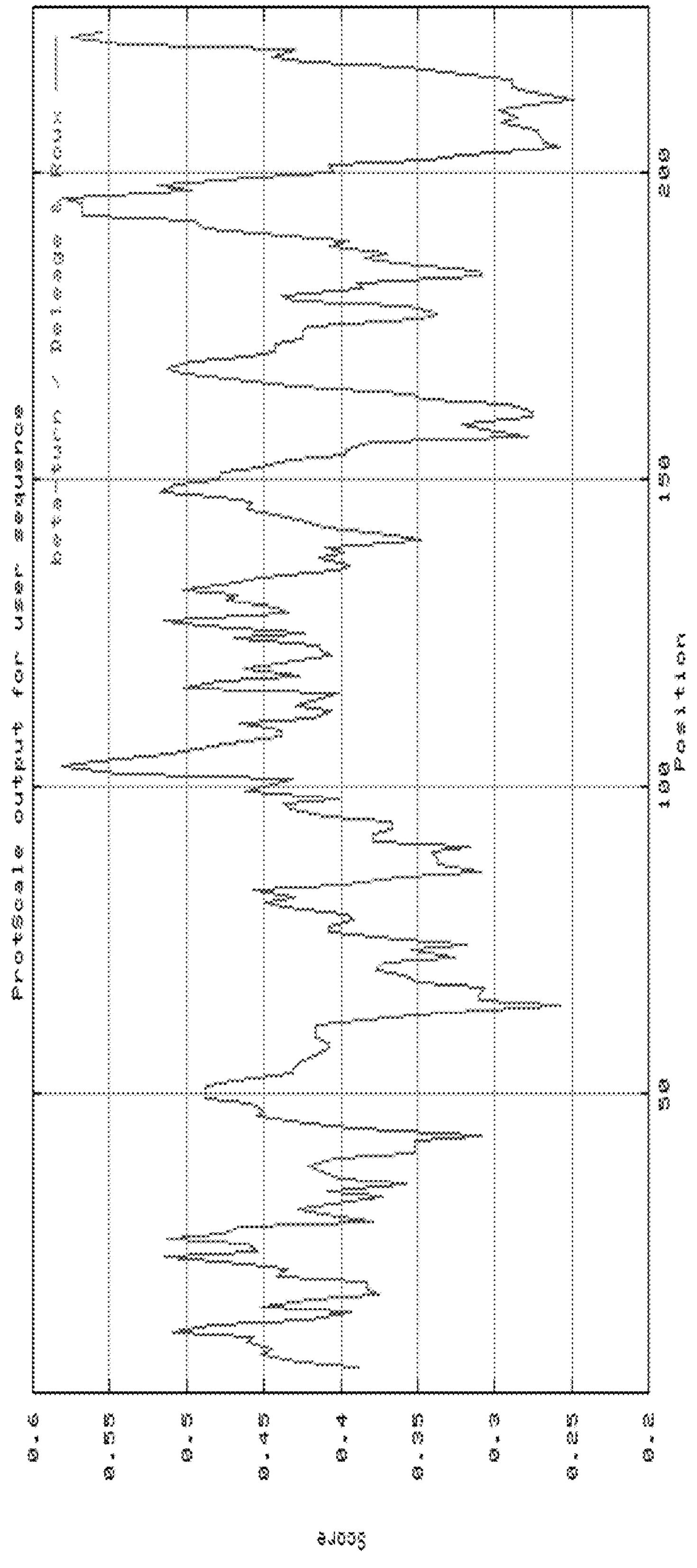

Figure 9J: 159P2B5 Beta-turn Profile
(Deleage, G., Roux B. 1987. Protein Engineering 1:289-294)
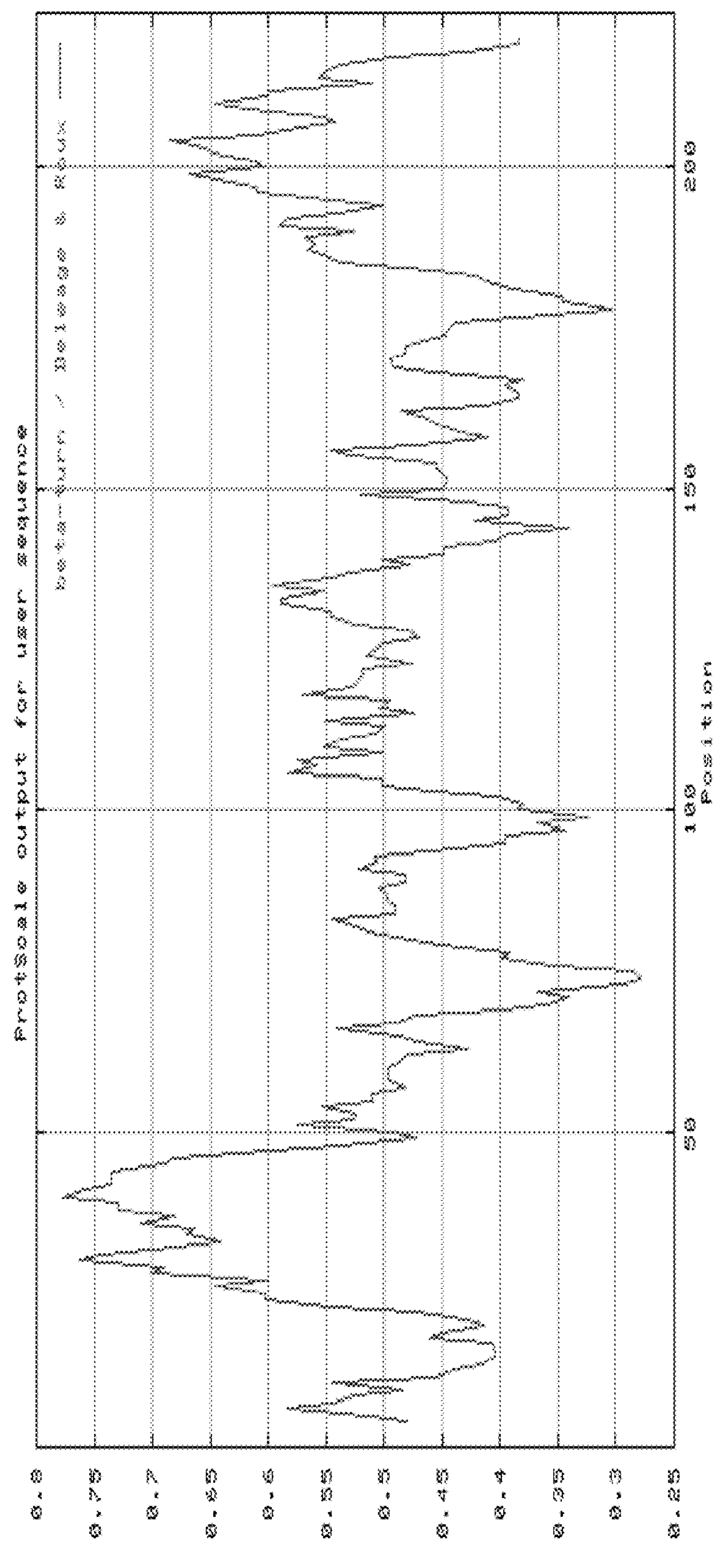

Figure 9K: 161P2B7a Beta-turn Profile
(Deleage, G., Roux B. 1987. Protein Engineering 1:289-294)
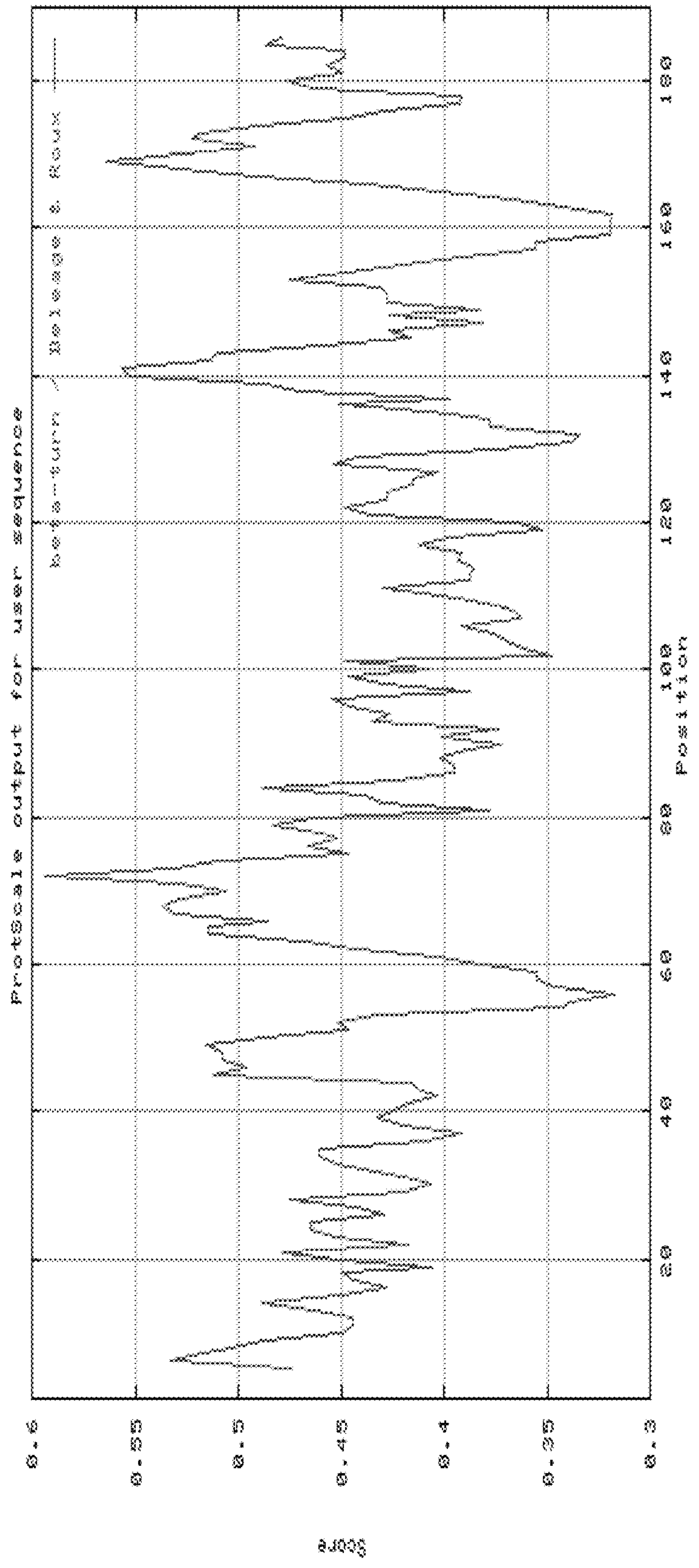

Figure 9L: 179P3G7 Beta-turn Profile
(Deleage, G., Roux B. 1987. Protein Engineering 1:289-294)
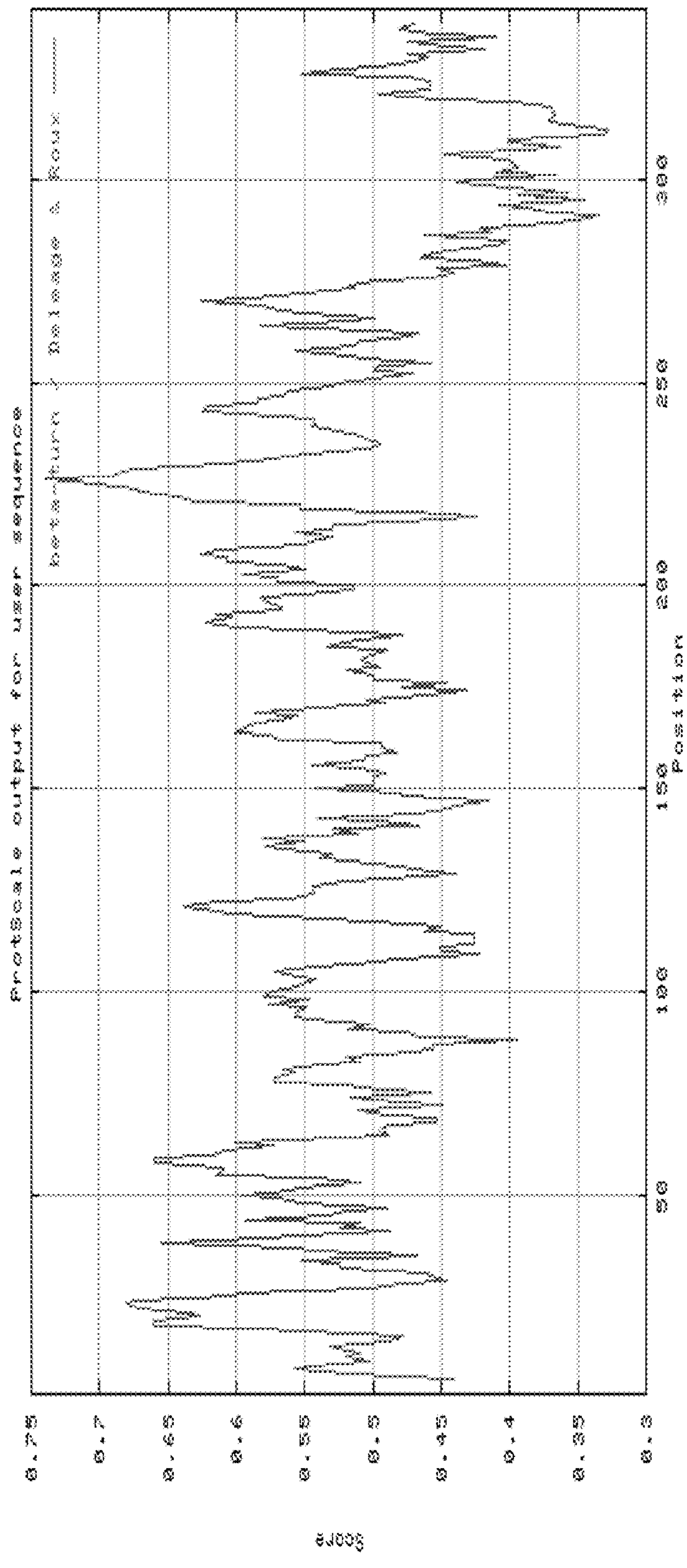

Figure 9M: 184P3C10b Beta-turn Profile
(Deleage, G., Roux B. 1987. Protein Engineering 1:289-294)
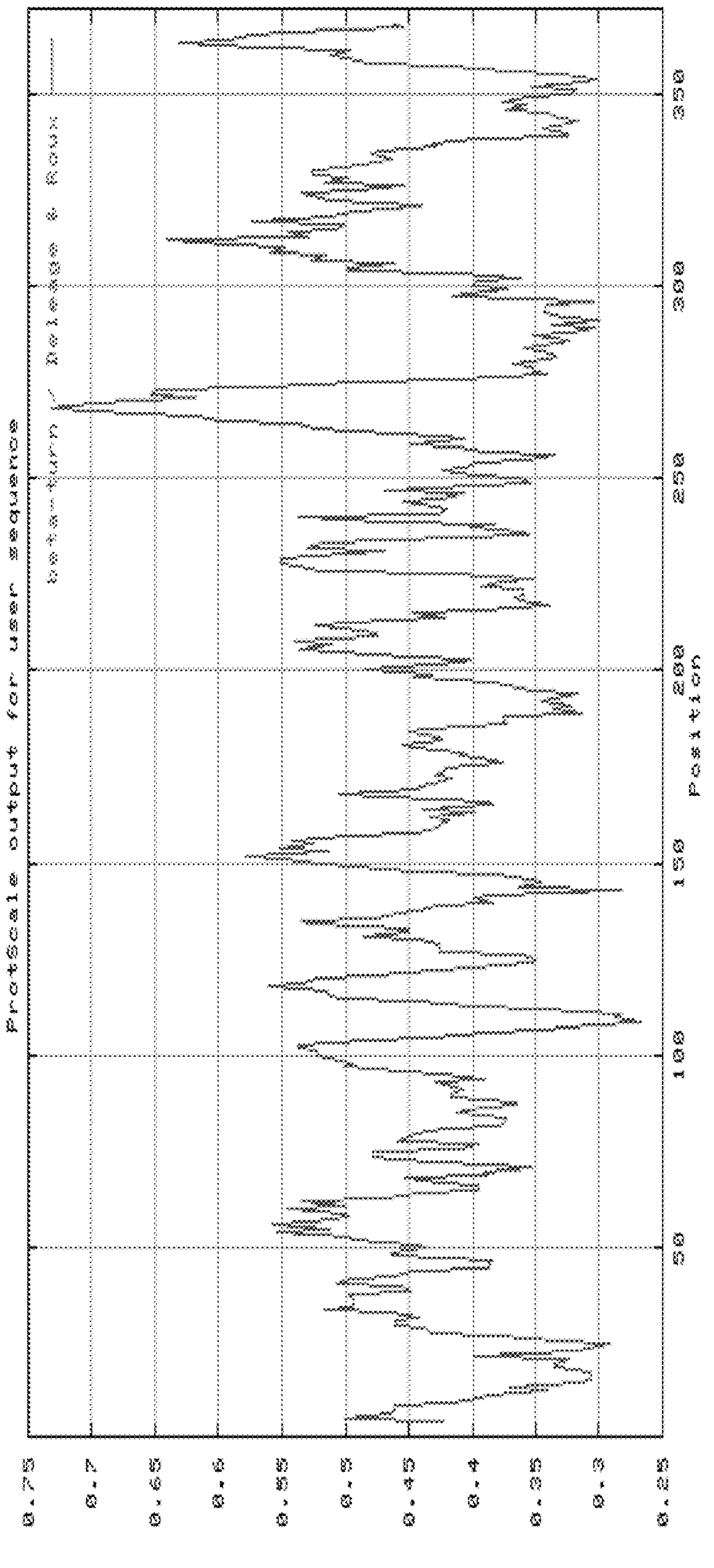

Figure 9N: 184P3G10 Beta-turn Profile
(Deleage, G., Roux B. 1987. Protein Engineering 1:289-294)
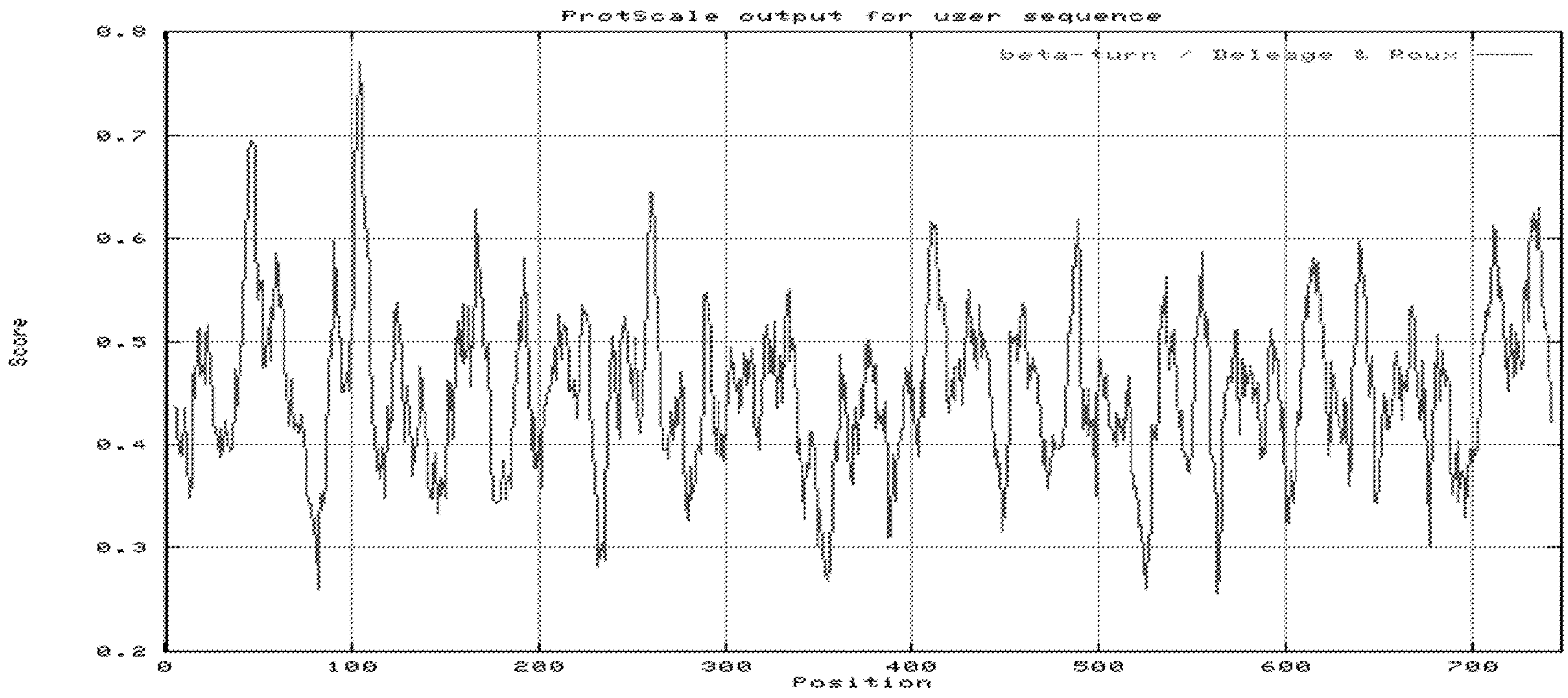

Figure 9O: 185P2C9 variant 1 Beta-turn Profile
(Deleage, G., Roux B. 1987. Protein Engineering 1:289-294)
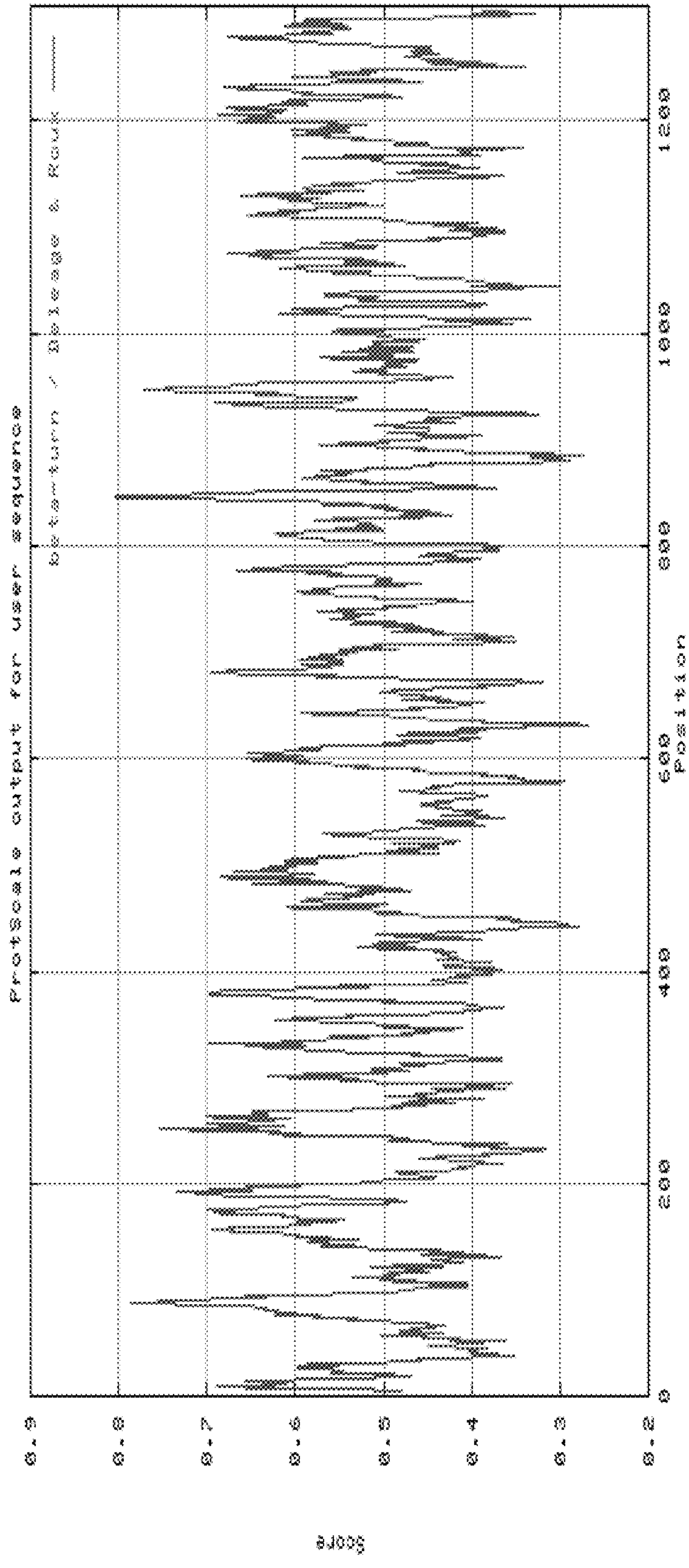

Figure 9P: 185P2C9 variant 2 Beta-turn Profile
(Deleage, G., Roux B. 1987. Protein Engineering 1:289-294)
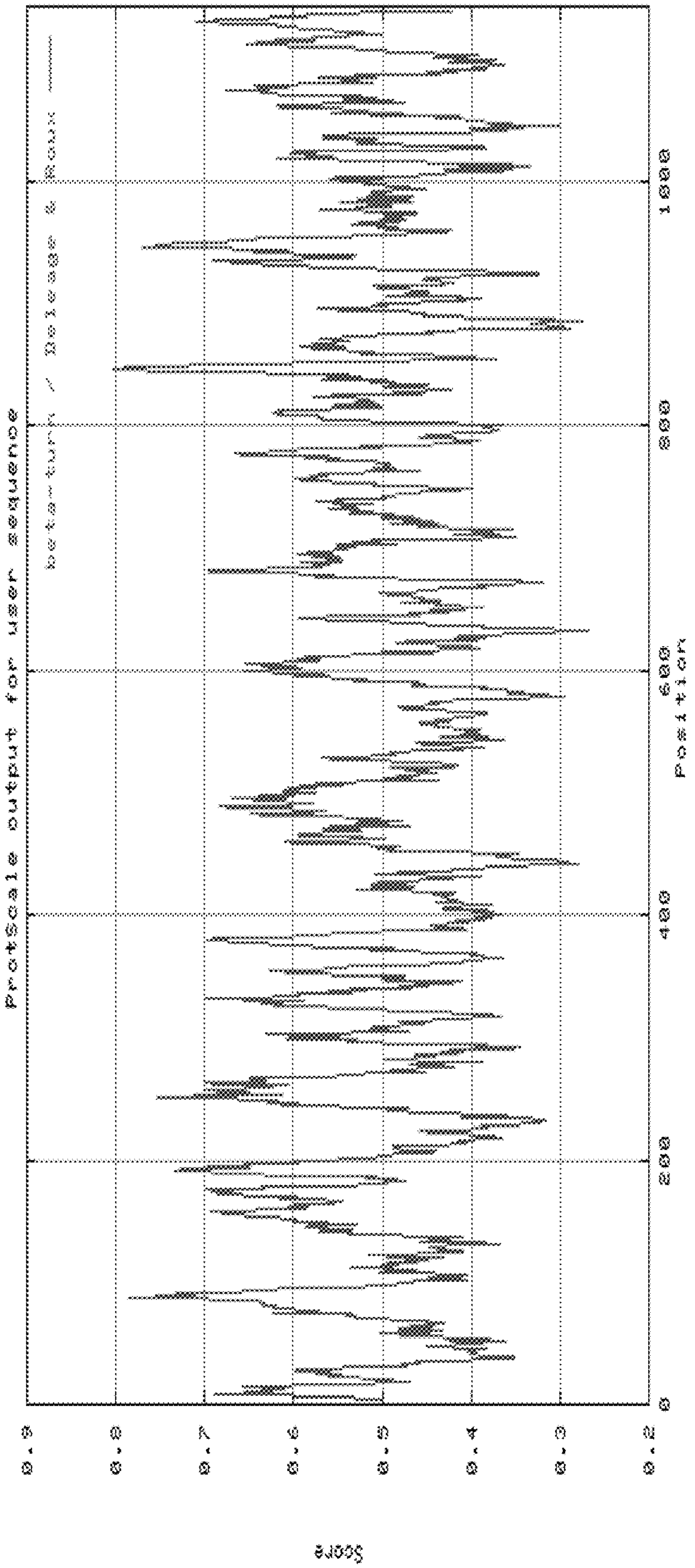

Figure 9Q: 185P2C9 variant 3 Beta-turn Profile
(Deleage, G., Roux B. 1987. Protein Engineering 1:289-294)
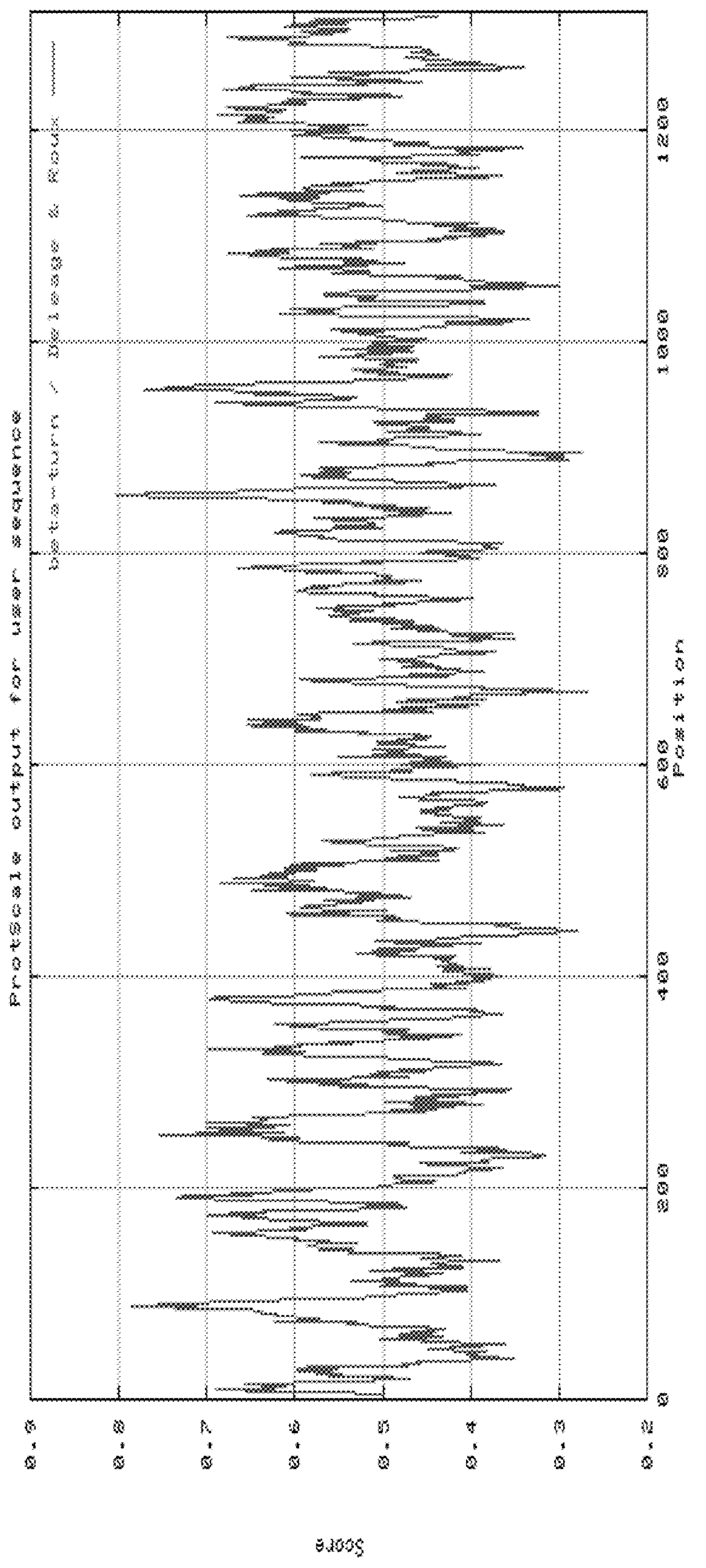

Figure 9R: 185P3C2 Beta-turn Profile
(Deleage, G., Roux B. 1987, Protein Engineering 1:289-294)
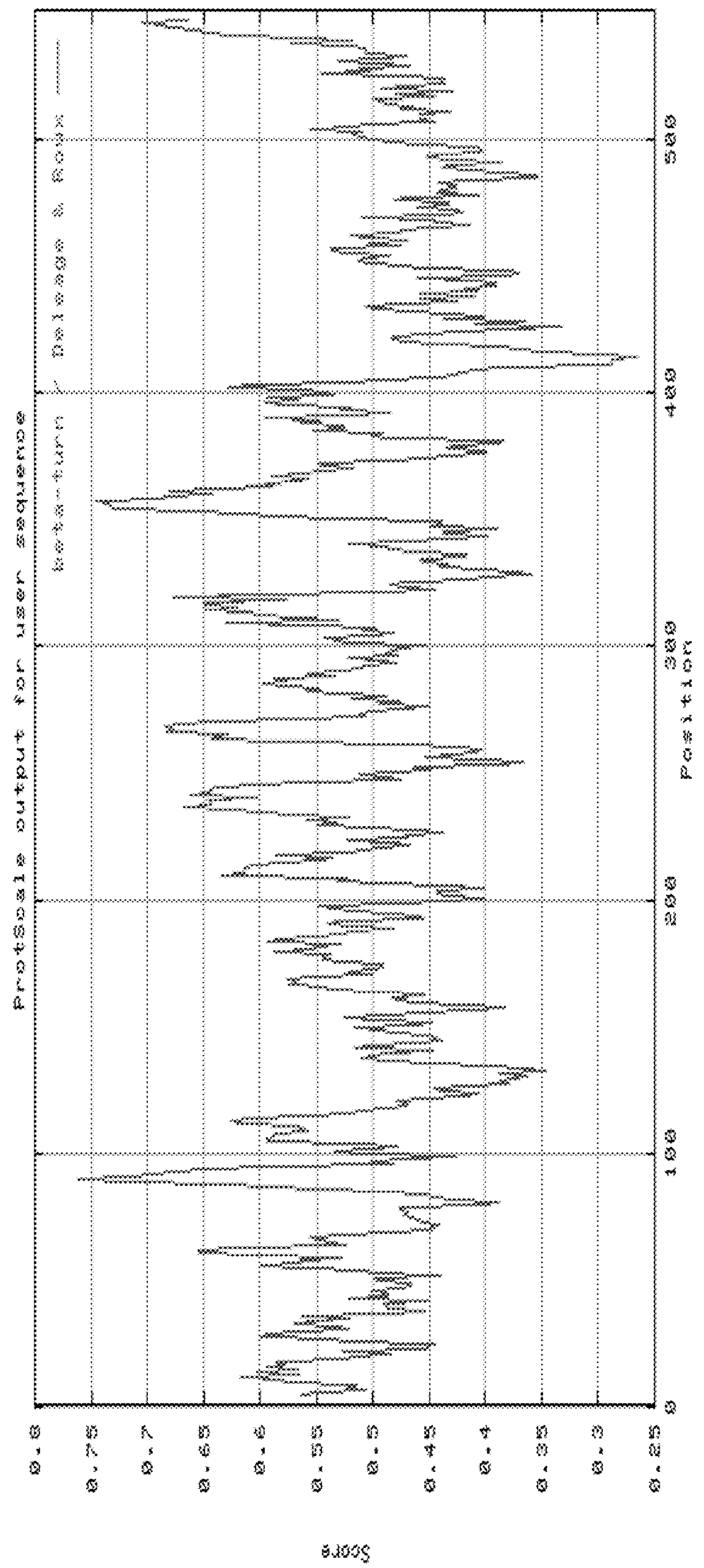

Figure 9S: 186P1H9 Beta-turn Profile
(Deleage, G., Roux B. 1987. Protein Engineering 1:289-294)
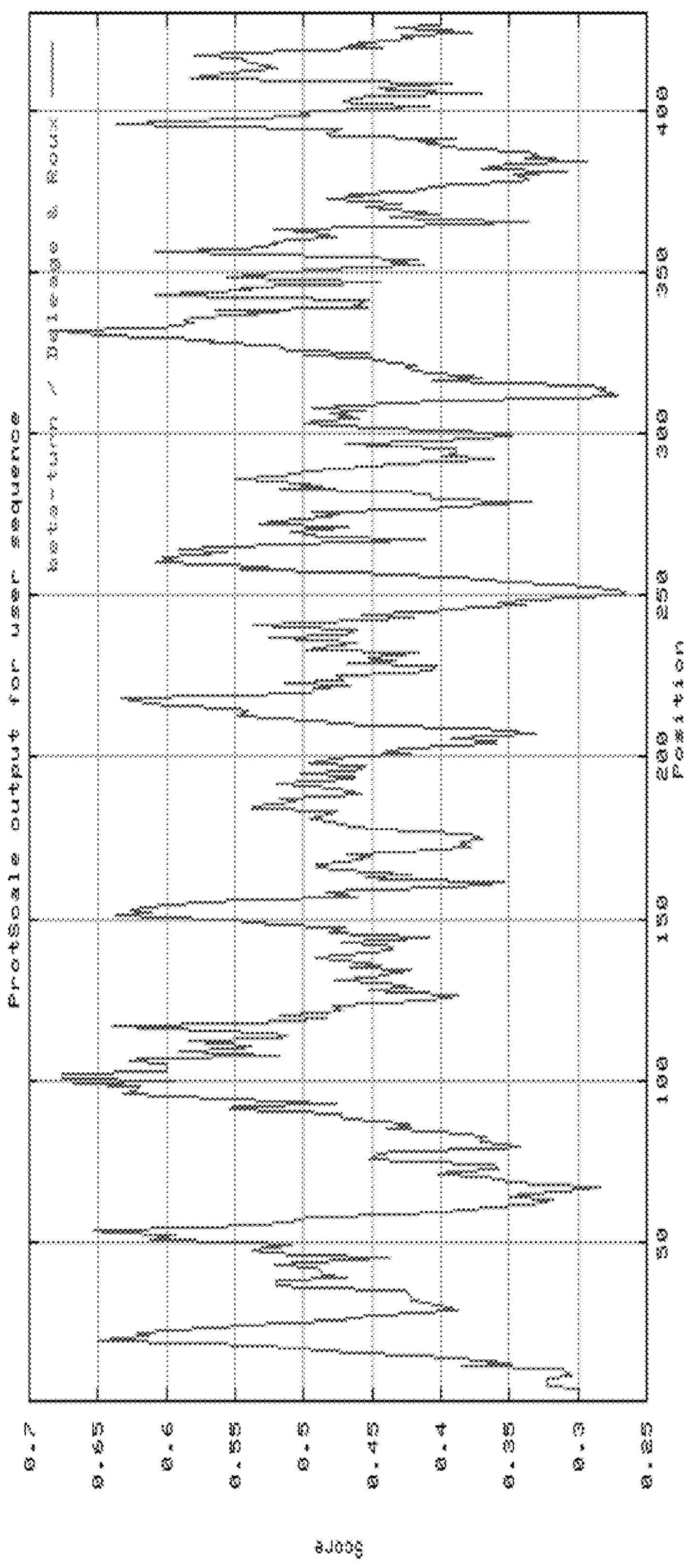

Figure 9T: 187P3F2 Beta-turn Profile
(Deleage, G., Roux B. 1987. Protein Engineering 1:289-294)
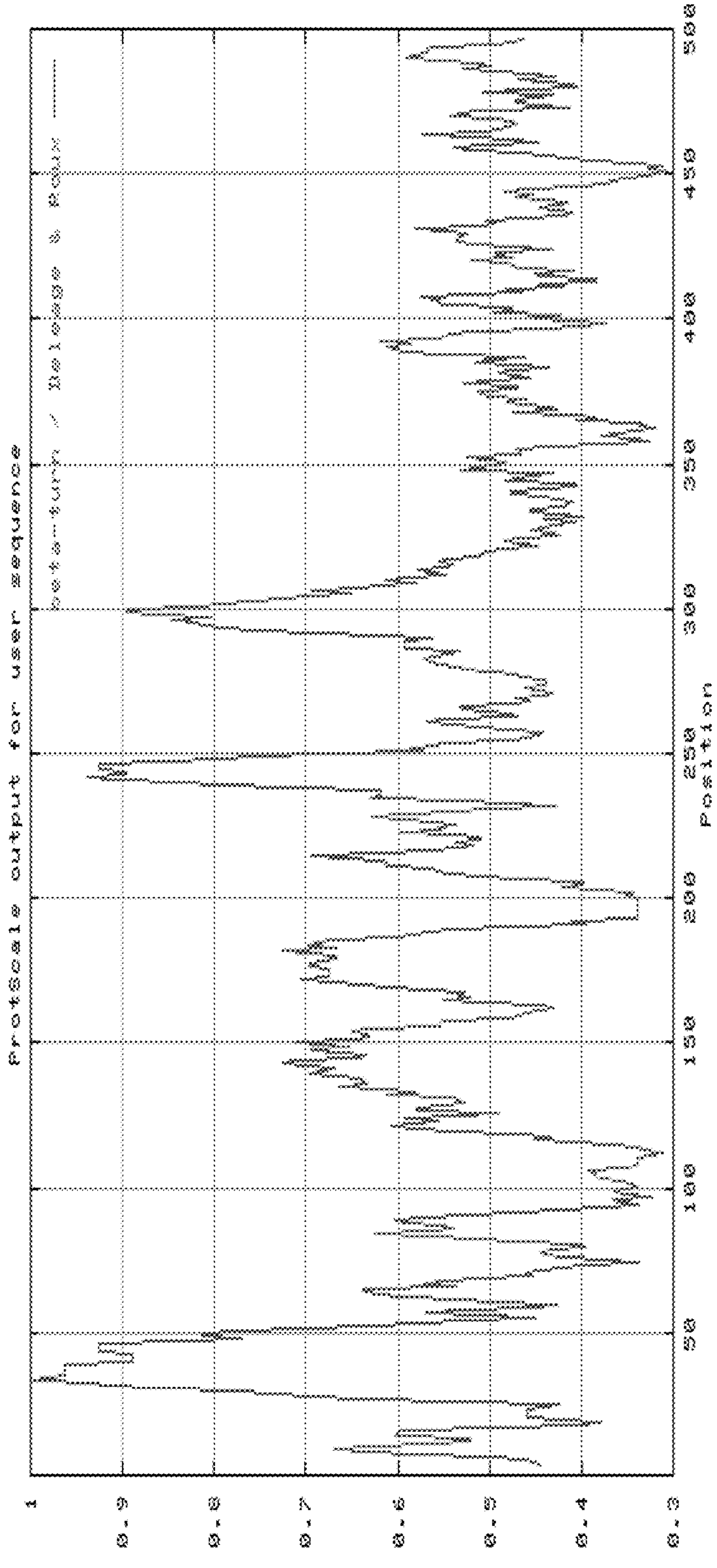

Figure 9U: 192P2G7 Beta-turn Profile
(Deleage, G., Roux B. 1987. Protein Engineering 1:289-294)
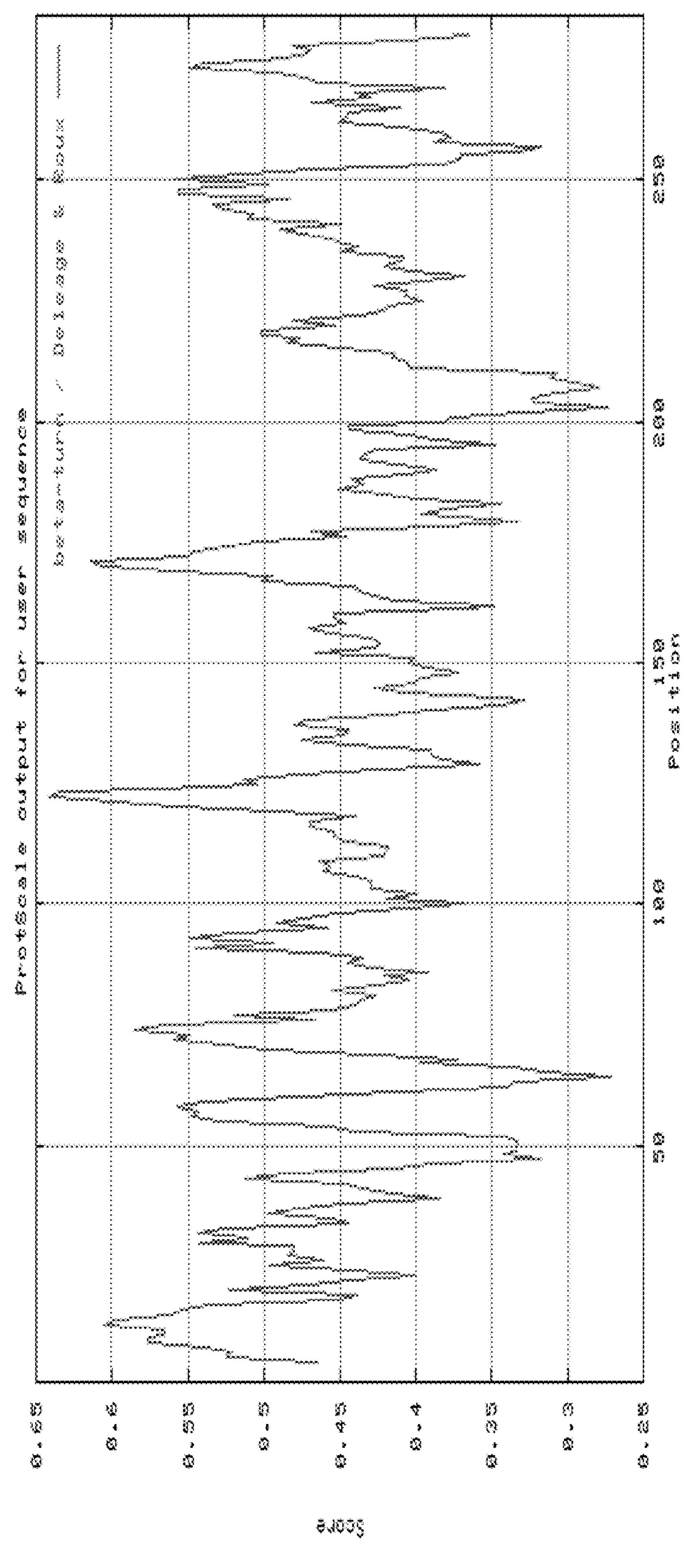

Figure 10A: Secondary structure of 74P3B3 variant 1

```
                10         20         30         40         50         60         70
                 |          |          |          |          |          |          |
MGQSKSKHSAYLHFIKLLLKRAGIKASTENLITLFPTVEQYCPWFPEHGTMDFKDWEQVGIALKQVCKEG
ccccccchhhhhhhhhhhhhhccccccchheeeecccccccccccccccccccchhhhhhhhhhhhhhcc
KFIPLTAWSNWAIVKAASEPFQSENEAYPPAERISAEEGGDAAEGGEDSEEDFEENTDKPGDELISFEEH
cceeeeeccchehhhhhhcccccccccccchccchccccccccccccccccccchchcccccceeeeecc
VGPSAAPKIEKPYMPRCLKQRRALRSSRLLIGIIRSGRLQ
cccccccccchhcchhhhhhhhhhhhhchheheeeeccccc

Alpha helix     (h):  31.67%
Extended strand (e):  11.67%
Random coil     (c): 56.67%
```

Figure 10B: Secondary structure of 74P3B3 variant 2

```
         10         20         30         40         50         60         70
          |          |          |          |          |          |          |
MFKTKKGLEEQSAPHWDHPEWPPPIKQCSLEPWRSESQICPVSRMNELWPQEPQAHGVAPVQHKAALPSN
cccccccccccccccccccccccccccccccccccccccccccccccccccccccccccccccccccccc
VNESPLQFIIRQARLAGDLDAWQFAVVLQPPRQQGGAHQAVWEPFSFKLLKDLKAAVGQYGPNSPFIRSL
cchhhhhhhhhhhhhccccchheeeeeecccccccccchhhhhchhhhhhhhhhhhhcccccchhhhhhh
LQSVAQNKLLTPCDWEILTKVTLSPSQFLQFKTWWTDEAQNQDRKNRAANPAIAITFEQLLGIGGQWGTV
hhhhhhhccccccceeeeeeeecccccceeeehhcccccccchcchhccccchhhehhhhhhhcccccccc
NNHQDFEMMPLNKFAIAV
cccccchhhchcheeecc

Alpha helix     (h):   29.82%
Extended strand (e):    9.65%
Random coil     (c):   60.53%
```

Figure 10C: Secondary structure of 83P4B8

83P4B8
Amino acids
1-630

```
         10         20         30         40         50         60         70
          |          |          |          |          |          |          |
MDQKILSLAAEKTADKLQEFLQTLREGDLTNLLQNQAVKGKVAGALLRAIFKGSPCSEEAGTLRRRKIYT
cchhhhhhhhhhhhhhhhhhhhhhhhccchhhhhhhhhhcchhhhhhhhhhhcccccchchhhhhhccee e
CCIQLVESGDLQKEIVSEIIGLLMLEAHHFPGPLLVELANEFISAVREGSLVNGKSLELLPIILTALATK
eeeeeccccchhhhhhhhhhhhhhhhcccccchhhhhhhhhhhhcccccccccchhhhhhhhhhhhh
KENLAYGKGVLSGEECKKQLINTLCSGRWDQQYVIQHTSMFKDVPLTAEEVEFVVEKALSMFSKMNLQEI
hhhhcccccccccchhhhhhhhhcccccccccheeeehhhhccccccchhhhhhhhhhhhhhhhcccccch
PFLVYQLLVLSSKGSRKSVLEGIIAFFSALDKQHNEEQSGDELLDVVTVPSGELRHVEGTIILHIVFAIK
hhhheeeeeeccccchhhhhhhhhhhhhhhccccccccccceeeeeeccccccceeeeeehhhhhhhhhh
LDYELGRELVKHLKVGQQGDSNNNLSPFSIALLLSVTRIQRFQDQVLDLLKTSVVKSFKDLQLLQGSKFL
hhhhhhhhhhheeeccccccccccccchhhhhhhhhhhhhhhhhhhhhhhhhhhhhhhhhhhhcccchhh
QNLVPHRSYVSTMILEVVKNSVHSWDHVTQGLVELGFILMDSYGPKKVLDGKTIETSFSLSRMPNQHACK
hcccccchhhhhhhhhhhhccccccchhhhhheeeeeeeccccccceeccccceeeccccccchhhhhhhh
LGANILLETFKIHEMIRQEILEQVLNRVVTRASSPISHFLDLLSNIVMYAPLVLQSCSSKVTEAFDYLSF
cchhhhhhhhhhhhhhhhhhhhhhhhhhhhhcccccchhhhhhhhhhhhhhcccehcccccchhhhhhhhhh
LPLQTVQRLLKAVQPLLKVSMSMRDCLILVLRKAMFANQLDARKSAVAGFLLLLKNFKVLGSLSSSQCSQ
cchhhhhhhhhhhhhhhhhhhhhhhhhhhhhhhhhhhhhhcchhhhhhhhhhhhhhhheehcccccccccc
SLSVSQVHVDVHSHYNSVANETFCLEIMDSLRRCLSQQADVRLMLYEGFYDVLRRNSQLANSVMQTLLSQ
ceeeeeeeeehccccchhhhhhhhhhhhhhhhhhhhhhhchhhhhhhhhhhhhhhhhchhhhhhhhhhhhhh
```

```
Alpha helix     (h): 58.36%
Extended strand (e): 9.26%
Random coil     (c): 32.38%
```

Figure 10D: Secondary structure of 83P4B8

```
          640       650       660       670       680       690       700
            |         |         |         |         |         |         |
LKQFYEPKPDLLPPLKLDACILTQGDKISLQEPLDYLLCCIQHCLAWYKNTVIPLQQGEEEEEEEEAFYE
hhhhcccccccccccceeeeecccccechhhhhhhhhhhhhhhhccccceecccccccchhhhhhhh
DLDDILESITNRMIKSELEDFELDKSADFSQSTSIGIKNNISAFLVMGVCEVLIEYNFSISSFSKNRFED
hhhhhhhhhhhhhhhhhhhccccccccccccceehhhhhhhhhhhhhhhheeeceeecccchhhhhh
ILSLFMCYKKLSDILNEKAGKAKTKMANKTSDSLLSMKFVSSLLTALFRDSIQSHQESLSVLRSSNEFMR
hhhhhhhhhhhhhhhhhhcccccccccchhhhhhhhhhhhhhhhhhhhhhhhhchehecccchhhhh
YAVNVALQKVQQLKETGHVSGPDGQNPEKIFQNLCDITRVLLWRYTSIPTSVEESGKKEKGKSISLLCLE
hhhhhhhhhhhhhhccccccccccchhhhhhhhhhhhhhheeeecccccccccccccccccceeeeeehh
GLQKIFSAVQQFYQPKIQQFLRALDVTDKEGEEREDADVSVTQRTAFQIRQFQRSLLNLLSSQEEDFNSK
hhhhhhhhhhhhhhhhhhhhhhhhccccccccccccccchhhhhhhhhhhhhhhhhhhhhcccccccchh
EALLLVTVLTSLSKLLEPSSPQFVQMLSWTSKICKENSREDALFCKSLMNLLFSLHVSYKSPVILLRDLS
hhhhhhhhhhhhhhcccccccchhehhhhccccccccccchhhhhhhhhhhhhhhheccccceeeeehhc
QDIHGHLGDIDQDVEVEKTNHFAIVNLRTAAPTVCLLVLSQAEKVLEEVDWLITKLKGQVSQETLSEEAS
hhhhccccccccccceehhccceeeeeeccccccceeeeeechhhhhhhhhhhhhhhcccccchcchhccc
SQATLPNQPVEKAIIMQLGTLLTFFHELVQTALPSGSCVDTLLKDLCKMYTTLTALVRYYLQVCQSSGGI
cccccccchhhhhhhhhhhhhhhhhhhhhcccccchhhhhhhhhhhhhhhhhhhhhhhhhecccccc
PKNMEKLVKLSGSHLTPLCYSFISYVQNKSKSLNYTGEKKEKPAAVATAMARVLRETKPIPNLIFAIEQY
hhhhhhhhhcccccccchhheehhhcccccccccccccccchhhhhhhhhhhhhhhccccchhheehhhh
EKFLIHLSKKSKVNLMQHMKLSTSRDFKIKGNILDMVLREDGEDENEEGTASEHGGQNKEPAKKKRKK
hhhheeccccccchhhhhhcccccccccceeecccccceeeeeeecccccccccccccccccccccchhhhccc
```

83P4B8
Amino acids
631-1328

Figure 10E: Secondary structure of 109P1D4

109P1D4
Amino acids
1-490

```
         10        20        30        40        50        60        70
          |         |         |         |         |         |         |
MDLLSGTYIFAVLLACVVFHSGAQEKNYTIREEMPENVLIGDLLKDLNLSLIPNKSLTTAMQFKLVYKTG
cchhhhhhhhhhhhhheecccccccccccceeecccccchehhhhhhhhcccecccccchhhhheeeehccc
DVPLIRIEEDTGEIFTTGARIDREKLCAGIPRDEHCFYEVEVAILPDEIFRLVKIRFLIEDINDNAPLFP
cceeeeeeccccceeecccccchhhhhhccccccccceeeeeeehhchhhhhhheeeeehhhhhcccccccc
ATVINISIPENSAINSKYTLPAAVDPDVGINGVQNYELIKSQNIFGLDVIETPEGDKMPQLIVQKELDRE
ceeeeeeccccccccccccccccccccccccchheeeeccceeeeeeeeeccccccccchheehhhhchc
EKDTYVMKVKVEDGGFPQRSSTAILQVSVTDTNDNHPVFKETEIEVSIPENAPVGTSVTQLHATDADIGE
cccceeeeeeeccccccccccceeeeeeeeccccccccceeceeeeeeeccccccccceeeeeecccccccc
NAKIHFSFSNLVSNIARRLFHLNATTGLITIKEPLDREETPNHKLLVLASDGGLMPARAMVLVNVTDVND
cceeeehhhhhhhhhhhhheccccceeeeecccccccccceeeeeeeccccccccceeeeeeeecccccc
NVPSIDIRYIVNPVNDTVVLSENIPLNTKIALITVTDKDADHNGRVTCFTDHEIPFRLRPVFSNQFLLET
cccceeeeeeecccccceeeecccccceeeeeeeeeecccccccceeeeeecccccccccchcchhhhh
AAYLDYESTKEYAIKLLAADAGKPPLNQSAMLFIKVKDENDNAPVFTQSFVTVSIPENNSPGIQLTKVSA
hhhcccccchhhhhhhhhhcccccchhhheeeeeccccccccceeeeeeeeeeeccccccceeeeeeee
```

```
Alpha helix     (h): 16.75%
Extended strand (e): 29.48%
Random coil     (c): 53.77%
```

Figure 10F: Secondary structure of 109P1D4

```
          500       510       520       530       540       550       560
            |         |         |         |         |         |         |
MDADSGPNAKINYLLGPDAPPEFSLDCRTGMLTVVKKLDREKEDKYLFTILAKDNGVPPLTSNVTVFVSI
cccccccccceeeeeeeccccccccccccccceeeehehcccccccccceeeeeeeecccccccccccceeeeeee
IDQNDNSPVFTHNEYNFYVPENLPRHGTVGLITVTDPDYGDNSAVTLSILDENDDFTIDSQTGVIRPNIS
eccccccceeeccccceecccccccccceeeeeeecccccccceeeeeeecccccceeeccccccceccccc
FDREKQESYTFYVKAEDGGRVSRSSSAKVTINVVDVNDNKPVFIVPPSNCSYELVLPSTNPGTVVFQVIA
cccccccceeeeeeeecccceeeecccceeeeeeeeeeccccccceeeeccccccceeeeeccccccceeeeeeeee
VDNDTGMNAEVCYSIVGGNTRDLFAIDQETGNITLMEKCDVTDLGLHRVLVKANDLGQPDSLFSVVIVNL
ecccccccceeeeeeeeeccchheeeecccccceeeeeccccccccchhhehhecccccccchhhhhhhhhh
FVNESVTNATLINELVRKSTEAPVTPNTEIADVSSPTSDYVKILVAAVAGTITVVVVIFITAVVRCRQAP
ehcccccchhhhhhhhhccccccccccccccccccchhhhhhhhhhhccceeeeeeeeeehhhhhhchcc
HLKAAQKNKQNSEWATPNPENRQMIMMKKKKKKKKHSPKNLLLNFVTIEETKADDVDSDGNRVTLDLPID
cchhhhhcccccccccccccchhhhhhhhhhhhcccccceeeeeeeeeccccccccccccccccceccccc
LEEQTMGKYNWVTTPTTFKPDSPDLARHYKSASPQPAFQIQPETPLNSKHHIIQELPLDNTFVACDSISK
cchcccccceeeeecccccccccchhchcccccccccccccccccccccceeeeecccccceeecccccc
CSSSSSDPYSVSDCGYPVTTFEVPVSVHTRPVGIQVSNTTF
ccccccccccccccccccceeeeeceeecccccceeeeccccc
```

109P1D4
Amino acids
491-1021

Figure 10G: Secondary structure of 151P4E11

```
         10         20         30         40         50         60         70
          |          |          |          |          |          |          |
MARGSALLLASLLLAAALSASAGLWSPAKEKRGWTLNSAGYLLGPHAVGNHRSFSDKNGLTSKRELRPED
ccchhhhhhhhhhhhhhhhhhhccccccccccccccccceeccccccccccccccccccccccccccccc
DMKPGSFDRSIPENNIMRTIIEFLSFLHLKEAGALDRLLDLPAAASSEDIERS
ccccccccccccchhhhhhhhhhhhhhhhhhhhhhhhhhhcccccccchchccc

Alpha helix     (h):  39.02%
Extended strand (e):   1.63%
Random coil     (c):  59.35%
```

Figure 10H: Secondary structure of 151P1C7a

```
         10         20         30         40         50         60         70
          |          |          |          |          |          |          |
MMALGAAGATRVFVAMVAAALGGHPLLGVSATLNSVLNSNAIKNLPPPLGGAAGHPGSAVSAAPGILYPG
ceeecccchhhhhhhhhhhhcccccceeeeechhhhcccchhhccccccccccccccccccccccceeccc
GNKYQTIDNYQPYPCAEDEECGTDEYCASPTRGGDAGVQICLACRKRRKRCMRHAMCCPGNYCKNGICVS
cccceecccccccccccccccccccccccccchhhehhhhhhhhhhhhhhccccccccccccceeee
SDQNHFRGEIEETITESFGNDHSTLDGYSRRTTLSSKMYHTKGQEGSVCLRSSDCASGLCCARHFWSKIC
ccccccccceeheeehcccccccccccccccceccccceeeeccccccceeeeecccccccchhhhhhhhhhh
KPVLKEGQVCTKHRRKGSHGLEIFQRCYCGEGLSCRIQKDHHQASNSSRLHTCQRH
ccccccccceecccccccccchhhhhhccccccceeeccccccccccccccccccc
```

Alpha helix (h): 22.56%

Extended strand (e): 13.91%

Random coil (c): 63.53%

Figure 10I: Secondary structure of 154P2A8

```
         10         20         30         40         50         60         70
          |          |          |          |          |          |          |
MGFNLTLAKLPNNELHGQESHNSGNRSDGPGKNTTLHNEFDTIVLPVLYLIIFVASILLNGLAVWIFFHI
cccceeheccccccccccccccccccccccccccchhhhhhhhhhhhhhhhhhhhhhhhhhhhheheee
RNKTSFIFYLKNIVVADLIMTLTFPFRIVHDAGFGPWYFKFILCRYTSVLFYANMYTSIVFLGLISIDRY
ccchhhhhhhhhhhhhhhhhhhcccceeecccccchhhhhhhhhhhhhhhhhhhhhhhhhhhhhhhhchh
LKVVKPFGDSRMYSITFTKVLSVCVWVIMAVLSLPNIILTNGQPTEDNIHDCSKLKSPLGVKWHTAVTYV
heeeecccccceeeehhhhhhhhhhhhhhhhhcccceeeeccccccccccccccccccccceeeeeeeeec
NSCLFVAVLVILIGCYIAISRYIHKSSRQFISQSSRKRKHNQSIRVVVAVFFTCFLPYHLCRIPFTFSHL
hhhhhhhhhhhhhhhhhhhhhhhhhcchhheeccccccccccceeeeeeehhhhhcccchhcccccchhh
DRLLDESAQKILYYCKEITLFLSACNVCLDPIIYFFMCRSFSRRLFKKSNIRTRSESIRSLQSVRRSEVR
hhhhhhhhhhhhhhhhhhhehhhhhhhccchhhhehhhhhhhhhhhhcccccccchhhhhhhhhcccceee
IYYDYTDV
eeeecccc

Alpha helix     (h): 53.35%
Extended strand (e): 13.69%
Random coil     (c): 32.96%
```

Figure 10J: Secondary structure of 156P1D4

```
        10         20         30         40         50         60         70
         |          |          |          |          |          |          |
MLWLLFFLVTAIHAELCQPGAENAFKVRLSIRTALGDKAYAWDTNEEYLFKAMVAFSMRKVPNREATEIS
ceeeeehhhhhhhhhhhcccchhhheeeeeehhhccccceeccchhhhhhhhhhhhhhhhcccchhhhhh
HVLLCNVTQRVSFWFVVTDPSKNHTLPAVEVQSAIRMNKNRINNAFFLNDQTLEFLKIPSTLAPPMDPSV
hhhhhccccceeeeeeeecccccccchhhhhhhhhhhhhhcccchheeecccchehheccccccccccccc
PIWIIIFGVIFCIIIVAIALLILSGIWQRRRKNKEPSEVDDAEDKCENMITIENGIPSDPLDMKGGHIND
chhehhhhhhhhhhhhhhhhhhhhhhhhhhccccccccccchhhhccceeeecccccccccccccccccch
AFMTEDERLTPL
heeccccccccc

Alpha helix     (h):  43.69%
Extended strand (e):  13.96%
Random coil     (c):  42.34%
```

Figure 10K: Secondary of 156P5C12

```
         10         20         30         40         50         60         70
          |          |          |          |          |          |          |
MAPCHIRKYQESDRQWVVGLLSRGMAEHAPATFRQLLKLPRTLILLLGGPLALLLVSGSWLLALVFSISL
ccccccccccccchhhhhhhhhhcchhhhhhhhhhhhcccchhheecccchhhhhhchhhhhhhhhhhhh
FPALWFLAKKPWTEYVDMTLCTDMSDITKSYLSERGSCFWVAESEEKVVGMVGALPVDDPTLREKRLQLF
hhhhhhhhhcccchecceeeeecccchhhhhhhhhccccceeeeecccceeeeeeecccccccccchhhhhhee
HLSVDSEHRRQGIAKALVRTVLQFARDQGYSEVILDTGTIQLSAMALYQSMGFKKTGQSFFCVWARLVAL
eeccccchhhhhhhhhhhhhhhhhhhccccceeeecccceehhhhhhhhhcccccchhhhhhhhhhhhhh
HTVHFIYHLPSSKVGSL
ceeeeeeeccccccccc

Alpha helix     (h):  49.78%
Extended strand (e):  16.30%
Random coil     (c):  33.92%
```

Figure 10L: Secondary structure of 159P2B5

```
        10         20         30         40         50         60         70
         |          |          |          |          |          |          |
MVKREHGQERPTFWGWAATPAPVSAPGNPPTGEGERQGSPPGGGFLGSTSFQRRGEKELLWERGQDVSRS
cccccccccccceeecccccccccccccccccccccccccccccccccchhhccchhhhhhccchhhhh
VLAMRAILPPSLSKSVHFPPLPHSCTLVALLSLGLQDPLGCRAPATKPTPAGATLSASSLPRPCSPSASL
hhhhhhcccccccccccccccccccchhhhhhhcccccccccccccccccccccccccccccccccchhh
LLSWPLFWGILGGVFFLGSRACTRTQARRHTGPAAALLRLLFPAPRRPGARSRAGYASPGSPERRSPGTA
hechchhhhccceeeecccccccchhhhhcccchhhhhhhcccccccccccccccccccccccccccccc
HKGSLPWPLALRLL
cccccccchhhhcc

Alpha helix     (h):  25.00%
Extended strand (e):   3.57%
Random coil     (c):  71.43%
```

Figure 10M: Secondary structure of 161P2B7a

```
        10        20        30        40        50        60        70
         |         |         |         |         |         |         |
MEDEGQTKIKQRRSRTNFTLEQLNELERLFDETHYPDAFMREELSQRLGLSEARVQVWFQNRRAKCRKQE
cchhhhhhhhhhccccccchhhhhhhhhhhhcccccchhhhhhhhhcccchhhhhhhhhhchhhhhhhhh
NQLHKGVLIGAASQFEACRVAPYVNVGALRMPFQQVQAQLQLDSAVAHAHHHLHPHLAAHAPYMMFPAPP
hcccceeeecchhhhhhhhcccccccchhhcchhhhhhhhhhhhhhhhhhcccccccccccccccccccc
FGLPLATLAADSASAASVVAAAAAAKTTSKNSSIADLRLKAKKHAAALGL
cccchhhcccchhhhhhhhhhhhhhhcccccchhhhhhhhhhhhhhhccc

Alpha helix     (h):  59.47%
Extended strand (e):  2.11%
Random coil     (c):  38.42%
```

Figure 10N: Secondary structure of 179P3G7

```
         10        20        30        40        50        60        70
          |         |         |         |         |         |         |
MEDEGQTKIKQRRSRTNFTLEQLNELERLFDETHYPDAFMREELSQRLGLSEARVQVWFQNRRAKCRKQE
cchhhhhhhhhhccccccchhhhhhhhhhhhcccccchhhhhhhhhcccchhhhhhhhhhchhhhhhhhh
NQLHKGVLIGAASQFEACRVAPYVNVGALRMPFQQVQAQLQLDSAVAHAHHHLHPHLAAHAPYMMFPAPP
hcccceeeecchhhhhhhhccccccccchhhcchhhhhhhhhhhhhhhhhhhcccccccccccccccccc
FGLPLATLAADSASAASVVAAAAAAKTTSKNSSIADLRLKAKKHAAALGL
cccchhhhcccchhhhhhhhhhhhhhccccccchhhhhhhhhhhhhhccc

Alpha helix     (h): 59.47%
Extended strand (e): 2.11%
Random coil     (c): 38.42%
```

Figure 10O: Secondary structure of 184P3C10b

```
         10         20         30         40         50         60         70
          |          |          |          |          |          |          |
MKYLRHRRPNATLILAIGAFTLLLFSLLVSPPTCKVQEQPPAIPEALAWPTPPTRPAPAPCHANTSMVTH
ccceccccchhhhhhhhhhhhhhhhhhhcccccccccccccccccccccccccccccccccccccccccc
PDFATQPQHVQNFLLYRHCRHFPLLQDVPPSKCAQPVFLLLVIKSSPSNYVRRELLRRTWGRERKVRGLQ
cccccchhhhhhhhhhhhhccccccccccccchceeeeeeecccccchhhhhhhhhhhhccchhhhhhhe
LRLLFLVGTASNPHEARKVNRLLELEAQTHGDILQWDFHDSFFNLTLKQVLFLQWQETRCANASFVLNGD
eeeeeeeccccccccchhhhhhhhhhhhccccceeechhhhhhhhhhhhhhhhhhhhhhcccceeeeeccc
DDVFAHTDNMVFYLQDHDPGRHLFVGQLIQNVGPIRAFWSKYYVPEVVTQNERYPPYCGGGGFLLSRFTA
cceeecccceeeeeeecccccceeeehhhhcccccchehhcccecceeeeeccccccccccchhhhhhhh
AALRRAAHVLDIFFPIDDVFLGMCLELEGLKPASHSGIRTSGVRAPSQHLSSFDPCFYRDLLLVHRFLPYE
hhhhhhhhhhccccchhhhhheeecccccccccccccccccccccccccccchhhhhhhhhhhhhhcchh
MLLMWDALNQPNLTCGNQTQIY
hhhhhhhhcccccccccccccc

Alpha helix     (h): 38.17%
Extended strand (e): 11.83%
Random coil     (c): 50.00%
```

Figure 10P: Secondary structure of 184P3G10

```
         10        20        30        40        50        60        70
          |         |         |         |         |         |         |
MNTAFAGKMVSVTKYDLTGCSAFCRSCQRATMTSQPLRLAEEYGPSPGESELAVNPFDGLPFSSRYYELL
ccccccccceeeeeeecccccchhhhhcccccccccchhhhhhccccccccccccccccccccchhhhhh
KQRQALPIWAARFTFLEQLESNPTGVVLVSGEPGSGKSTQIPQWCAEFALARGFQKGQVTVTQPYPLAAR
hhhccccchhhhhhhhhhhcccccceeeeeecccccccccchhhhhhhhhhhhhccccceeecccccchhhh
SLALRVADEMDLTLGHEVGYSIPQEDCTGPNTLLRFCWDRLLLQEVASTRGTGAWGVLVLDEAQERSVAS
hhhhhhhhhhecccccccccccccccccchhhhhhhhhhhhhhhhcccccceeeeeecccccccccch
DSLQGLLQDARLEKLPGDLRVVVVTDPALEPKLRAFWGNPPIVHIPREPGERPSPIYWDTIPPDRVEAAC
hhhhhhhhhhhhhcccceeeeeecccccccchhhhhcccccceeccccccccccccccccccccchhhhhh
QAVLELCRKELPGDVLVFLPSEEEISLCCESLSREVESLLLQGLPPRVLPLHPDCGRAVQAVYEDMDARK
hhhhhhhhhcccceeeeccccccceeehhhhhhhhhhhhhhhcccccccccccccchhhhhhhhhhccccce
VVVTHWLADFSFSLPSIQHVIDSGLELRSVYNPRIRAEFQVLRPISKCQAEARRLRARGFPPGSCLCLYP
eeeeeeeeccccccccchhhhecccccceecccccccceehhhhhcccchhhhhhhhhhhhcccccccceeecc
KSFLELEAPPLPQPRVCEENLSSLVLLLKRRQIAEPGECHFLDQPAPEALMQALEDLDYLAALDDDGDLS
cceeeeeccccccccccchhhhhhhhhhhhhhhhcccccccccccccchhhhhhhhhhhhhhhhhccccccc
DLGVILSEFPLAPELAKALLASCEFDCVDEMLTLAAMLTAAPGFTRPPLSAEEAALPRALEHTDGDHSSL
cceeeeecccchhhhhhhhhhhcchhhhhhhhhhhhhhhccccccccccchhhhhhhhhhhhcccccchh
IQVYEAFIQSGADEAWCQARGLNWAALCQAHKLRGELLELMQRIELPLSLPAFGSEQNRRDLQKALVSGY
hhhhhhhhcchhhhhhhhhhccchhhhhhhhhcchhhhhhhhhhhcccccccccccchhhhhhhhhhhccc
FLKVARDTDGTGNYLLLTHKHVAQLSSYCCYRSRRAPARPPPWVLYHNFTISKDNCLSIVSEIQPQMLVE
eeeeeccccccccchehhhhhhhhhcccceeeeccccccccccccccceeeeeeeeecccccceeeehcccccheeh
LAPPYFLSNLPPSESRDLLNQLREGMADSTAGSKSSSAQEFRDPCVLQ
ccccccccccccchhhhhhhhhhhccccccccccccchhcccccccccc
```

Alpha helix (h): 41.71%

Extended strand (e): 11.76%

Random coil (c): 46.52%

Figure 10Q: Secondary structure of 185P2C9 variant 1

185P2C9 variant 1
Amino acids
1-630

```
             10         20         30         40         50         60         70
              |          |          |          |          |          |          |
MEDMRGQQEREGPGRDHAPSIPTSPFGDSLESSTELRRHLQFVEEEAELLRRSISEIEDHNRQLTHELSK
cccccccccccccccccccccccccccccccchhhhhhhhhhhhhhhhhhhhhhhhhhhhhhhhhhhhhh
FKFEPPREPGWLGEGASPGAGGGAPLQEELKSARLQISELSGKVLKLQHENHALLSNIQRCDLAARLGLR
eccccccccccccccccccccccccchhhhhhhhhhhhhhhhhhhchhhhhhhhhcchhhhhhhhhhhcccc
APSPRDSDAESDAGKKESDGEESRLPQPKREGPVGGESDSEEMFEKTSGFGSGKPSEASEPCPTELLKAR
ccccccccccccccccccccccccccccccccccccccccccccccchhhhhhcccccccccchhhhccc
EDSEYLVTLKHEAQRLERTVERLITDTDSFLHDAGLRGGAPLPGPGLQGEEEQGEGDQQEPQLLGTINAK
ccchhhhhhhhhhhhhhhhhhhhhhhcchhehccccccccccccccccccccccccccccchhhhhhhhhh
MKAFKKELQAFLEQVNRIGDGLSPLPHLTESSSFLSTVTSVSRDSPIGNLGKELGPDLQSRLKEQLEWQL
hhhhhhhhhhhhhhhhhhcccccccccccccccceeeeeeeeeccccccccccccchcchhhhhhhhhhhhc
GPARGDERESLRLRAARELHRRADGDTGSHGLGGQTCFSLEMEEEHLYALRWKELEMHSLALQNTLHERT
ccccchhhhhhhhhhhhhhhhhcccccccccccccceeeechhhhhhhhhhhhhhhhhhhhhhhhccchcc
WSDEKNLMQQELRSLKQNIFLFYVKLRWLLKHWRQGKQMEEEGEEFTEGEHPETLSRLGELGVQGGHQAD
cchhhhhhhhhhhhhhhhhhhhhhhhhhhhhhhhhhcccccchcccccccchhhhhccceeccccccccc
GPDHDSDRGCGFPVGEHSPHSRVQIGDHSLRLQTADRGQPHKQVVENQQLFSAFKALLEDFRAELREDER
cccccccccccccccccccceecccceeeccccccccccccchhhhhhhhhhhhhhhhhhhhhhhhhhhhh
ARLRLQQQYASDKAAWDVEWAVLKCRLEQLEEKTENKLGELGSSAESKGALKKEREVHQKLLADSHSLVM
hhhhhhhhccccchhhhhhhhhhhhhhhhhhhhhhccccccchcchhhhhhhhhhhhhhhhhhhhhhchhhh
Alpha helix     (Hh) :   472 is  36.11%
Extended strand (Ee) :    75 is   5.74%
Random coil     (Cc) :   760 is  58.15%
```

Figure 10R: Secondary structure of 185P2C9 variant 1

185P2C9 variant 1
Amino acids
631-1307

```
         640       650       660       670       680       690       700
           |         |         |         |         |         |         |
DLRWQIHHSEKNWNREKVELLDRLDRDRQEWERQKKEFLWRIEQLQKENSPRRGGSFLCDQKDGNVRPFF
hhhheccccccchhhhhhhhhhhccccchhhhhhhhhhhhhhhhhhhcccccccceeccccccccccccc
HQGSLRMPRPVAMWPCADADSIPFEDRPLSKLKESDRCSASENLYLDALSLDDEPEEPPAHRPEREFRNR
cccccccccccccccccccccccccchccccccccccccccccchheeeehecccccccccccccchhhhcc
LPEEEENHKGNLQRAVSVSSMSEFQRLMDISPFLPEKGLPSTSSKEDVTPPLSPDDLKYIEEFNKSWDYT
ccchhhhhcccccceeeeecchhhhhhhhhcccccccccccccccccccccccccchhhhhcccccccc
PNRGHNGGGPDLWADRTEVGRAGHEDSTEPFPDSSWYLTTSVTMTTDTMTSPEHCQKQPLRSHVLTEQSG
cccccccccccccccccccccccccccccccceeeeeeeeeecccccccccccccccccceeeeeeeccc
LRVLHSPPAVRRVDSITAAGGEGPFPTSRARGSPGDTKGGPPEPMLSRWPCTSPRHSRDYVEGARRPLDS
eeeeccccccceccceeecccccccccccccccccccccccccccccccccccccchhhcchcccccc
PLCTSLGFASPLHSLEMSKNLSDDMKEVAFSVRNAICSGPGELQVKDMACQTNGSRTMGTQTVQTISVGL
cccccccccccccceccccccchhhhhhhhhhhhhhhcccccchhhhhhhcccccccccccceeeeeeecc
QTEALRGSGVTSSPHKCLTPKAGGGATPVSSPSRSLRSRQVAPAIEKVQAKFERTCCSPKYGSPKLQRKP
chhhcccccccccccccccccccccccccccccccccccchhhhhhhhhhhhhhhccccccccccccccc
LPKADQPNNRTSPGMAQKGYSESAWARSTTTRESPVHTTINDGLSSLFNIIDHSPVVQDPFQKGLRAGSR
ccccccccccccccccccccccchecccccccccccccccchhhhhhhhehhecccccchhhhhhhcccccc
SRSAEPRPELGPGQETGTNSRGRSPSPIGVGSEMCREEGGEGTPVKQDLSAPPGYTLTENVARILNKKLL
cccccccccccccccccccccccccccccccccccccccccccccccccccccccchhhhhhhhhhhhhh
EHALKEERRQAAHGPPGLHSDSHSLGDTAEPGPMENQTVLLTAPWGL
hhhhhhhhhhhccccccccccccccccccccccccccceeeeeeccccc
```

Figure 10S: Secondary structure of 185P2C9 variant 2

185P2C9 variant 2
Amino acids
1-630

```
              10         20         30         40         50         60         70
               |          |          |          |          |          |          |
MEDTRGQQEREGPGRDHAPSIPTSPFGDSLESSTELRRHLQFVEEEAELLRRSISEIEDHNRQLTHELSK
cccccccccccccccccccccccccccccccchhhhhhhhhhhhhhhhhhhhhhhhhhhhhhhhhhhhhh
FKFEPPREPGWLGEGASPGAGGGAPLQEELKSARLQISELSGKVLKLQHENHALLSNIQRCDLAAHLGLR
ecccccccccccccccccccccccccccchhhhhhhhhhhchhhhhhhhhcchhhhhhhhhhhhhcccc
AFSPRDSDAESDAGKKESDGEESRLPQPKREGPVGGESDSEEMFEKTSGFGSGKPSEASEPCPTELLKAR
cccccccccccccccccccccccccccccccccccccchhhhhhhhcccccccccccccccccchhhhccc
EDSEYLVTLKHEAQRLERTVERLITDTDSFLHDAGLRGGAPLPGPGLQGEEEQGEGDQQEPQLLGTINAK
ccchhhhhhhhhhhhhhhhhhhhhccchhehcccccccccccccccccccccccccccccchhhhhhhhhhh
MKAFKKELQAFLQQVNRIGDGLSPLPHLTESSSFLSTVTSVSRDSPIGNLGKELGPDLQSRLKEQLEWQL
hhhhhhhhhhhhhhhhhhcccccccccccccceeeeeeeecccccccchcchhhhhhhhhhhhhhhhhc
GPAQGDERESLRLRAARELHRRADGDTGSHGLGSQTCFSLEMEEEHLYALRWKELEMHSLALQNTLHERT
ccccchhhhhhhhhhhhhhhhhcccccccccccccceeeechhhhhhhhhhhhhhhhhhhhhhhcccchcc
WSDEKNLMQQELRSLKQNIFLFYVKLRWLLKHWRQGKQMEEEGEEFTEGEHPETLSRLGELGVQGGHQAD
cchhhhhhhhhhhhhhhhhhhhhhhhhhhhhhhcccccchccccccccccccchhhhhccceeccccccccc
GPDHDSDRGCGFPVGEHSPHSRVQIGDHSLRLQTADRGQPHKQVVENQQLFSAFKALLEDFRAELREDER
ccccccccccccccccccccceeeccccceeeccccccccccchhhhhhhhhhhhhhhhhhhhhhhhhhhh
ARLRLQQQYASDKAAWDVEWAVLKCRLEQLEEKTENKLGELGSSAESKGALKKEREVHQKLLADSHSLVM
hhhhhhhhccccchhhhhhhhhhhhhhhhhhhhhhhhhhcccccchcchhhhhhhhhhhhhhhhhchhhhh
Alpha helix     (h): 37.57%
Extended strand (e):  5.87%
Random coil     (c): 56.57%
```

Figure 10T: Secondary structure of 185P2C9 variant 2

```
        640       650       660       670       680       690       700
          |         |         |         |         |         |         |
DLRWQIHHSEKNWNREKVELLDRLDRDRQEWERQKKEFLWRIEQLQKENSPRRGGSFLCDQKDGNVRPFP
hhhheccccccccchhhhhhhhhhccccchhhhhhhhhhhhhhhhhhhcccccccccceeccccccccccc
HQGSLRMPRPVAMWPCADADSIPFEDRPLSKLKESDRCSASENLYLDALSLDDEPEEPPAHRPEREFRNR
cccccccccccccccccccccccccchccccccccccccccchheeeeheccccccccccccccchhhhcc
LPEEEENHKGNLQRAVSVSSMSEFQRLMDISPFLPEKGLPSTSSKEDVTPPLSPDDLKYIEEFNKSWDYT
ccchhhhccccccceeeeechhhhhhhhhhcccccccccccccccccccccccccchhhhhccccccccc
PNRGHNGGGPDLWADRTEVGRAGHEDSTEPFPDSSWYLTTSVTMTTDTMTSPEHCQKQPLRSHVLTEQSG
cccccccccccccccccccccccccccccccccccccccceeeeeeeeeecccccccccceeeeeeccc
LRVLHSPPAVRRVDSITAAGGEGPFPTSRARGSPGDTKGGPPEPMLSRWPCTSPRHSRDYVEGARRPLDS
eeeccccccceccceeeccccccccccccccccccccccccccccccccccccccccchhhcchccccc
PLCTSLGFASPLHSLEMSKNLSDDMKEVAFSVRNAICSGPGELQVKDMACQTNGSRTMGTQTVQTISVGL
cccccccccccccceccccccchhhhhhhhhhhhhhhhcccccchhhhhhcccccccccccceeeeeeecc
QTEALRGSGVTSSPHKCLTPKAGGGATPVSSPSRSLRSRQVAPAIEKVQAKFERTCCSPKYGSPKLQRKP
chhhccccccccccccccccccccccccccccccccchhhhhhhhhhhhhccccccccccccccccccc
LPKADQPNNRPGNRHQFPRKVA
cccccccccccccccccccccc
```

185P2C9 variant 2
Amino acids
631-1142

Figure 10U: Secondary structure of 185P2C9 variant 1

185P2C9 variant 1
Amino acids
1-630

```
         10         20         30         40         50         60         70
          |          |          |          |          |          |          |
MEDTRGQQEREGPGRDHAPSIPTSPFGDSLESSTELRRHLQFVEEEAELLRRSISEIEDHNRQLTHELSK
cccccccccccccccccccccccccccccccchhhhhhhhhhhhhhhhhhhhhhhhhhhhhhhhhhhhhh
FKFEPPREPGWLGEGASPGAGGGAPLQEELKSARLQISELSGKVLKLQHENHALLSNIQRCDLAAHLGLR
ecccccccccccccccccccccccchhhhhhhhhhhhhhhhchhhhhhhhcchhhhhhhhhhhhhhcccc
APSPRDSDAESDAGKKESDGEESRLPQPKWEGPVGGESDSEEMFEKTSGFGSGKPSEASEPCPTELLKAR
ccccccccccccccccccccccccccccccccccccccchhhhhhccccccccccccccccccchhhccc
EDSEYLVTLKHEAQRLERTVERLITDTDSFLHDAGLRGGAPLPGPGLQGEEEQGEGDQQEPQLLGTINAK
ccchhhhhhhhhhhhhhhhhhhhhhhhhhccchhehcccccccccccccccccccccccchhhhhhhhhh
MKAFKKELQAFLEQVNRIGDGLSPLPHLTESSSFLSTVTSVSRDSPIGNLGKELGPDLQSRLKEQLEWQL
hhhhhhhhhhhhhhhhhhhhhcccccccccccccccccceeeeeeeecccccccccchcchhhhhhhhhhc
GPARGDERESLRLRAARELHRRADGDTGSHGLGGQTCFSLEMEEEHLYALRWKELEMHSLALQNTLHERT
cccccchhhhhhhhhhhhhhhhcccccccccccccccceeeechhhhhhhhhhhhhhhhhhhhhhhcchcc
WSDEKNLMQQELRSLKQNIFLFYVKLRWLLKHWRQGKQMEEEGEEFTEGEHPETLSRLGELGVQGGHQAD
cchhhhhhhhhhhhhhhhhhhhhhhhhhhhhhhhccccchccccccccccchhhhhccceeccccccccc
GPDHDSDRGCGFPVGEHSPHSRVQIGDHSLRLQTADRGQPHKQVVENQQLFSAFKALLEDFRAELREDER
cccccccccccccccccccccceeccccceecccccccccccchhhhhhhhhhhhhhhhhhhhhhhhhhhhh
ARLRLQQQYASDKAAWDVEWAVLKCRLEQNCCGYPRINIEEETLGFTRLPAGSTVKTLKSLGLQRLELEE
hhhhhhhhccccchhhhhhhhhhhhhhhhcccccccceeeeccccccccccccchhhhhcchhhhhhhhhhh
Alpha helix     (h): 36.56%
Extended strand (e):  5.48%
Random coil     (c): 57.96%
```

Figure 10V: Secondary structure of 185P2C9 variant 1

185P2C9 variant 1
Amino acids
631-1313

```
         640       650       660       670       680       690       700
           |         |         |         |         |         |         |
KTENKLGELGSSAESKGALKKEREVHQKLLADSHSLVMDLRWQIHHSEKNWNREKVELLDRLDRDRQEWE
hhhhhhcccccchhccchhhhhhhhhhhhhhchhhhhhhhhheccccccccchhhhhhhhhhhcccchhhh
RQKKEFLWRIEQGSLRMPRPVAMWPCADADSIPFEDRPLSKLKESDRCSASENLYLDALSLDDEPEEPPA
hhhhhhhhhhhcccccccccccccccccccccchcccccccccccccccchheeeeheccccccccccc
HRFEREFRNRLPEEEENHKGNLQRAVSVSSMSEFQRLMDISPFLPEKGLPSTSSKEDVTPPLSPDDLKYI
ccchhhhhccccchhhhhcccccceeeeeecchhhhhhhhhcccccccccccccccccccccccccchhh
EEFNKSWDYTPNRGHNGGGPDLWADRTEVGRAGHEDSTEPFPDSSWYLTTSVTMTTDTMTSPEHCQKQPL
hhhcccccccccccccccccccccccccccccccccccccccceeeeeeeeeeccccccccccccccc
RSHVLTEQSGLRVLHSPPAVRRVDSITAAGGEGPFPTSRARGSPGDTKGGPPEPMLSRWPCTSPRHSRDY
ceeeeeecccceeeeecccccccecccceeeecccccccccccccccccccccccccccccccccccccch
VEGARRPLDSPLCTSLGFASPLHSLEMSKNLSDDMKEVAFSVRNAICSGPGELQVKDMACQTNGSRTMGT
hhcchcccccccccccccccccceccccccchhhhhhhhhhhhhhhcccccchhhhhhccccccccccc
QTVQTISVGLQTEALRGSGVTSSPHKCLTPKAGGGATPVSSPSRSLRSRQVAPAIEKVQAKFERTCCSPK
ceeeeeeeccchhhccccccccccccccccccccccccccccccchhhhhhhhhhhhhcccccc
YGSPKLQRKPLPKADQPNNRTSPGMAQKGYSESAWARSTTTRESPVHTTINDGLSSLFNIIDHSPVVQDP
ccccccccccccccccccccccccccccccchecccccccccccccchhhhhhhehheccccccchhh
FQKGLRAGSRSRSAEPRPELGPGQETGTNSRGRSPSPIGVGSEMCREEGGEGTPVKQDLSAPPGYTLTEN
hhhccccccccccccccccccccccccccccccccccccccccccccccccccccccccccccchhhh
VARILNKKLLEHALKEERRQAAHGPPGLHSDSHSLGDTAEPGPMEELPCSALA
hhhhhhhhhhhhhhhhhhhhhcccccccccccccccccccccccccccccccc
```

Figure 10W: Secondary structure of 185P3C2

```
        10        20        30        40        50        60        70
         |         |         |         |         |         |         |
NCLLRPKNKSVRWGPGAGAALLRPSPAALGAGSRACSVPPAAPAQTPRPQVSAPAWGPGRAARGSGRMER
cccccccccceecccccccchhccccccccccccccccccccccccccccccccccccccccccccchhhhh
RMKAGYLDQQVPYTFSSKSPGNGSLREALIGPLGKLMDPGSLPPLDSEDLFQDLSHFQETWLAEAQVPDS
hhhcccccccccceecccccccchhhhhhccccccccccccccccchhhhhhhhhhhhhhhhhhcccccc
DEQFVPDFHSENLAFHSPTTRIKKEPQSPRTDPALSCSRKPPLPYHHGEQCLYSSAYDPPRQIAIKSPAP
ccccccccccccecccccccccccccccccccccccccccccccccccceeeccccccccceeeccccc
GALGQSPLQPFPRAEQRNFLRSSGTSQPHPGHGYLGEHSSVFQQPLDICHSFTSQGGGREPLPAPYQHQL
cccccccchhhhhhhhhhhhhcccccccccccccccchhhhcccceeeccccccccccccccccccccccc
SEPCPPYPQQSFKQEYHDPLYEQAGQPAVDQGGVNGHRYPGAGVVIKQEQTDFAYDSDVTGCASMYLHTE
cccccccccccchhchcchhcccccccccccccccccccccceeeeeecccceecccccccceeeeeecc
GFSGPSPGDGAMGYGYEKPLRPFPDDVCVVPEKFEGDIKQEGVGAFREGPPYQRRGALQLWQFLVALLDD
ccccccccccccccccccccccccccccccccccccccccccccccccccchhchhhhhhhhhhhhhhcc
PTNAHFIAWTGRGMEFKLIEPEEVARLWGIQKNRPAMNYDKLSRSLRYYYEKGIMQKVAGERYVYKFVCE
cccceeeeecccccceehcchhhhhhhhhccccccccchhhhhhhhhhhhhhhhhcccceeeeeeeeeec
PEALFSLAFPDNQRPALKAEFDRPVSEEDTVPLSHLDESPAYLPELAGPAQPFGPKGGYSY
ccheeeecccccchcccchhhcccccccccccccccccccccccccccccccccccccccc
```

Alpha helix (h): 19.42%

Extended strand (e): 6.53%

Random coil (c): 72.05%

Figure 10X: Secondary structure of 186P1H9

```
10        20        30        40        50        60        70
         |         |         |         |         |         |         |
MLALLAASVALAVAAGAQDSPAPGSRFVCTALPPEAVHAGCPLPAMPMQGGAQSPEEELRAAVLQLRETV
chhhhhhhhhhhcccccccccccccccceeeecccccccccccccccccccccchhhhhhhhhhhhhhhh
VQQKETLASARAIRELTGKLARCEGLAGGKARGAGATGKDTMGDLPRDPGHVVEQLSRSLQTLKDRLESL
hhhhhhhhhhhhhhhhhhhhhhhcccccccccccccccccccccccccchhhhhhhhhhhhhhhhhhhhh
EHQLRANVSNAGLPGDFREVLQQRLGELERQLLRKVAELEDEKSLLHNETSAHRQKTESTLNALLQRVTE
hhhhhccccccccccchhhhhhhhhhhhhhhhhhhhhhhhhhhhhheccccccccccchhhhhhhhhhhhhh
LERGNSAFKSPDAFKVSLPLRTNYLYGKIKKTLPELYAFTICLWLRSSASPGIGTPFSYAVPGQANEILL
hhcccccccccceeccccccccchhhchhhhhhhhhhhhhheeeeecccccccccceccccccccccceeee
IEWGNNPIELLINDKVAQLPLFVSDGKWHRICVTWTTRDGMWEAFQDGEKLGTGENLAPWHPIKPGGVLI
eecccchhhehhhhhhcccceeecccccceeeeeeeeeecccchhhhhhccccccccccccccccccccceee
LGQEQDTVGGRFDATQAFVGELSQFNIWDRVLRAQEIVNIANCSTNMPGNIIPWVDNNVDVFGGASKWPV
ecccccccccccchhhhhcchchhhhhhhhhhhhhhhhhhhhhhchccccceeecccccccccccccccc
ETCEEALLDL
chhhhhhhcc

Alpha helix     (h): 43.95%
Extended strand (e):  9.30%
Random coil     (c): 46.74%
```

Figure 10Y: Secondary structure of 187P3F2

```
          10         20         30         40         50         60         70
           |          |          |          |          |          |          |
MATAASNPYLPGNSLLAAGSIVHSDAAGAGGGGGGGGSGGGGAGGGGGGMQPGSAAVTSGAYRGDPSSV
cccccccccccccheecchee
KMVQSDFMQGAMAASNGGHMLSHAHQWVTALPHAAAAAAAAAAAAVEASSPWSGSAVGMAGSPQQPPQPP
eeehhhhhhhhhhhccccchhhcchhhhhhchhhhhhhhhhhhhhhhhhhhcccccccecccccccccccc
PPPPQGPDVKGGAGRDDLHAGTALHHRGPPHLGPPPPPHQGHPGGWGAAAAAAAAAAAAAAAAAHLPSMA
cccccccccccccccccccccccccccccccccccccccccccccchhhhhhhhhhhhhhhhhhhccccc
GGQQPPPQSLLYSQPGGFTVNGMLSAPPGPGGGGGGAGGGAQSLVHPGLVRGDTPELAEHHHHHHHHAHP
ccccccccccceecccccceecccccccccccccccccccccccceeccccccccchhhhccccccccccc
HPPHPHHAQGPPHHGGGGGGAGPGLNSHDPHSDEDTPTSDDLEQFAKQFKQRRIKLGFTQADVGLALGTL
cccccccccccccccccccccccccccccccccccccchhhhhhhhhhhhhhhcccchhhhhhehhhhhh
YGNVFSQTTICRFEALQLSFKNMCKLKPLLNKWLEEADSSTGSPTSIDKIAAQGRKRKKRTSIEVSVKGA
cccccchhhhhhhhhhhhhhhhhhhhchhhhhhhccccccccccchhhhhhhcchcccccceeeeeeccc
LESHFLKCPKPSAQEITNLADSLQLEKEVVRVWFCNRRQKEKRMTPPGIQQQTPDDVYSQVGTVSADTPP
hhhcccccccccchhhhhhhhhhhhhhhhhhhhhhcccccchhcccccccccccccccccceeeeecccccc
PHHGLQTSVQ
cccccccccc

Alpha helix     (h): 30.80%
Extended strand (e):  5.80%
Random coil     (c): 63.40%
```

Figure 10Z: Secondary structure of 192P2G7

```
        10        20        30        40        50        60        70
         |         |         |         |         |         |         |
MAESEAETPSTPGEFESKYFEFHGVRLPPFCRGKMEEIANFPVRPSDVWIVTYPKSGTSLLQEVVYLVSQ
ccccccccccccccccheeeeccccccccccccchhhhccccccccceeeeecccccchhhhhhhhhheec
GADPDEIGLMNIDEQLPVLEYPQPGLDIIKELTSPRLIKSHLPYRFLPSDLHNGDSKVIYMARNPKDLVV
cccccceeeeecccccccccccccchhhhhccccceeeccccccecccccccccceeeeeeeccccheee
SYYQFHRSLRTMSYRGTFQEFCRRFMNDKLGYGSWFEHVQEFWEHRMDSNVLFLKYEDMHRDLVTMVEQL
eeeehhhhhchccccccchhhhhhhhhhcccccchhhhhhhhhhcccccceeeehhhhhhhhhhhhhhhh
ARFLGVSCDKAQLEALTEHCHQLVDQCCNAEALPVGRGRVGLWKDIFTVSMNEKFDLVYKQKMGKCDLTF
hhhhccccchhhhhhhhhhhhhhhccccccccccccccceehhhhhehechhhhhhhhhhhhhccccceee
DFYL
eecc

Alpha helix      (h): 36.27%
Extended strand  (e):  16.20%
Random coil      (c): 47.54%
```

Figure 11:

Figure 11b Nucleotide sequences of transcript variants of 83P4B8 (SEQ ID NO:115).

```
>83P4B8 v.2
cggagttctg tgatatgagc aacaatggac cagaagattt tatctctagc agcagaaaaa      60
acagcagaca aactgcaaga atttcttcaa accctgagag aaggtgattt gactaatctc     120
cttcagaatc aagcagtgaa aggaaaagtt gctggagcac tcctgagagc catcttcaaa     180
ggttccccct gctctgagga agctggaaca cttaggagac gtaagatata cacttgttgt     240
atccagttgg tggaatcggg ggatttgcag aaagaaatag tgtctgagat cataggatta     300
ctgatgctgg aggctcacca ttttccagga ccattattgg ttgaattagc caatgagttt     360
attagtgctg tcagagaagg cagcctagtg aatggaaaat ctttggagtt actacctatc     420
attctcactg ccctggctac gaaaaaggaa aatctggctt atggaaaagg tgggatcagc     480
aatatgtaat ccaacacacc tccatgttca aggatgtccc tctgactgca gaagaggtgg     540
aatttgtggt ggaaaaagca ttgagcatgt tctccaagat gaatcttcaa gaaataccac     600
ctttggtcta tcagcttctg gttctctcct ccaagggaag cagaaagagt gttttggaag     660
gaatcatagc cttcttcagt gcactagata agcagcacaa tgaggaacag agtggtgacg     720
agctattgga tgttgtcact gtgccatcag gtgaacttcg tcatgtggaa ggcaccatta     780
ttctacacat tgtgtttgcc atcaaattgg actatgaact aggcagagaa ctcgtgaaac     840
acttaaaggt aggacagcaa ggagattcca ataataactt aagtcccttc agcattgctc     900
ttcttctgtc tgtaacaaga atacaaagat ttcaggacca ggtgcttgat cttttaaaga     960
cttcggttgt aaagagcttt aaggatcttc aactcctcca aggctcaaaa tttcttcaga    1020
atctagttcc tcatagatct tatgtttcaa ccatgatctt ggaagtagtg aagaatagcg    1080
ttcatagctg ggaccatgtt actcagggcc tcgtagaact tggtttcatt ttgatggatt    1140
catatgggcc aaagaaggtt cttgatggaa aaactattga aaccagccca agtctttcta    1200
gaatgccaaa ccagcatgca tgtaagctcg gagctaatat cctgttggaa acttttaaga    1260
tccatgagat gatcagacaa gaaattttgg agcaggtcct caacagggtt gttaccagag    1320
catcttctcc catcagtcat ttcttagacc tgctttcaaa tatcgtcatg tatgcaccct    1380
tagttcttca aagttgttct tctaaagtca cagaagcttt tgactatttg tcctttctgc    1440
cccttcagac tgtacaaagg ctgcttaagg cagtgcagcc ccttctcaaa gtcagcatgt    1500
caatgagaga ctgcttgata cttgtccttc ggaaagctat gtttgccaac cagcttgatg    1560
cccgaaaatc tgcagttgct gggtttttgc tgctcctgaa gaactttaaa gttttaggca    1620
gcctgtcatc ctctcagtgc agtcagtctc tcagtgtcag tcaggttcat gtggatgttc    1680
acagccatta caattctgtc gccaatgaaa ctttttgcct tgagatcatg gatagtttga    1740
ggagatgctt aagccagcaa gctgatgttc gactcatgct ttatgagggg ttttatgatg    1800
ttcttcgaag gaactctcag ctggctaatt cagtcatgca aactctgctc tcacagttaa    1860
aacagttcta tgagccaaaa cctgatctgc tgcctcctct gaaattagat gcttgtattc    1920
tgacccaagg agataagatc tctctacaag aaccactgga ttatctgctg tgttgtattc    1980
agcattgttt ggcctggtat aagaatacag tcataccctt acagcaggga gaggaggaag    2040
aggaggagga agaggcattc tacgaagacc tagatgatat attggagtcc attactaata    2100
gaatgattaa gagtgagctg gaagactttg aactggataa atcagcagat ttttctcaga    2160
gcaccagtat tggcataaaa aataatatct ctgctttttt tgtgatggga gtttgtgagg    2220
```

Figure 11b (continued)

```
ttttaataga atacaatttc tccataagta gtttcagtaa gaataggttt gaggacattc    2280
tgagcttatt tatgtgttac aaaaaactct ctgacattct taatgaaaaa gcgggtaaag    2340
ccaaaactaa aatggccaac aagacaagtg atagtctttt gtccatgaaa tttgtgtcca    2400
gtcttctcac tgctcttttc agggatagta tccaaagcca ccaagaaagc ctttctgttc    2460
tcaggtccag caatgagttt atgcgctatg cagtgaatgt agctctgcag aaagtacagc    2520
agctaaagga aacagggcat gtgagtggcc ctgatggcca aaacccagaa aagatctttc    2580
agaacctctg tgacataact cgagtcttgc tatggagata cacttcaatt cctacttcag    2640
tggaagagtc gggaaagaaa gagaaaggaa agagcatctc actgctgtgc ttggagggtt    2700
tacagaaaat attcagtgct gtgcaacagt tctatcagcc caagattcag cagtttctca    2760
gagctctgga tgtcacagat aaggaaggag aagagagaga agatgcagat gtcagtgtca    2820
ctcagagaac agcattccag atccggcaat ttcagaggtc cttgttgaat ttacttagca    2880
gtcaagagga agattttaat agcaaagaag ccctcctgct agtcacggtt cttaccagtt    2940
tgtccaagtt actggagccc tcctctcctc agtttgtgca gatgttatcc tggacatcaa    3000
agatttgcaa ggaaaacagc cgggaggatg ccttgttttg caagagcttg atgaacttgc    3060
tcttcagcct gcatgtttcg tataagagtc ctgtcattct gctgcgtgac ttgtcccagg    3120
atatccacgg gcatctggga gatatagacc aggatgtaga ggtggagaaa acaaaccact    3180
ttgcaatagt gaatttgaga acggctgccc ccactgtctg tttacttgtt ctgagtcagg    3240
ccgagaaggt tctagaagaa gtggactggc taatcaccaa gcttaaggga caagtgagcc    3300
aagaaacctt atcagaagag gcctcttctc aggcaaccct accaaatcag cctgttgaga    3360
aagctatcat catgcaactg ggaactctgc ttacattttt ccacgagctg gtgcagacag    3420
ctctgcccatc aggcagctgt gtggacacct tgttaaagga cttgtgcaaa atgtacacca    3480
cacttacagc ccttgtcaga tattatctcc aggtgtgtca gagctccgga ggaatcccaa    3540
aaaatatgga aaagctggtg aagctgtctg gttctcatct gacccccctg tgttattctt    3600
tcatttctta cgtacagaat aagagtaaga gcctgaacta tacgggagag aaaaaggaga    3650
aacctgctgc cgttgccaca gccatggcca gagttcttcg ggaaaccaag ccaatcccta    3720
acctcatctt tgccatagaa cagtatgaaa aatttctcat ccacctttct aagaagtcca    3780
aggtgaacct gatgcagcac atgaagctca gcacctcacg agacttcaag atcaaaggaa    3840
acatcctaga catggttctt cgagaggatg gcgaagatga aaatgaagag ggcactgcat    3900
cagagcatgg gggacagaac aaagaaccag ccaagaagaa aaggaaaaaa taaatgaaat    3960
gcctgagtta atgtg                                                     3975
```

>83P4B8 v.3 (SEQ ID NO:116).

```
cggagttctg tgatatgagc aacaatggac cagaagattt tatctctagc agcagaaaaa      60
acagcagaca aactgcaaga atttcttcaa accctgagag aaggtgattt gactaatctc     120
cttcagaatc aagcagtgaa aggaaaagtt gctggagcac tcctgagagc catcttcaaa     180
ggttcccccct gctctgagga agctggaaca cttaggagac gtaagatata cacttgttgt     240
atccagttgg tggaatcggg ggatttgcag aaagaaatag tgtctgagat catagggatta     300
ctgatgctgg aggctcacca ttttccagga ccattattgg ttgaattagc caatgagttt     360
```

Figure 11b (continued)

```
attagtgctg tcagagaagg cagcctagtg aatggaaaat ctttggagtt actacctatc     420
attctcactg ccctggctac gaaaaaggaa aatctggctt atggaaaagg tgtactgagt     480
ggggaagaat gtaagaaaca gttgattaac accctgtgtt ctggcaggtg ggatcagcaa     540
tatgtaatcc aacacacctc catgttcaag gatgtccctc tgactgcaga agaggtggaa     600
tttgtggtgg aaaaagcatt gagcatgttc tccaagatga atcttcaaga aataccacct     660
ttggtctatc agcttctggt tctctcctcc aagggaagca gaaagagtgt tttggaagga     720
atcatagcct tcttcagtgc actagataag cagcacaatg aggaacagag tggtgacgag     780
ctattggatg ttgtcactgt gccatcaggt gaacttcgtc atgtggaagg caccattatt     840
ctacacattg tgtttgccat caaattggac tatgaactag gcagagaact cgtgaaacac     900
ttaaaggtag gacagcaagg agattccaat aataacttaa gtcccttcag cattgctctt     960
cttctgtctg taacaagaat acaaagattt caggaccagg tgcttgatct tttaaagact    1020
tcggttgtaa agagctttaa ggatcttcaa ctcctccaag gctcaaaatt tcttcagaat    1080
ctagttcctc atagatctta tgtttcaacc atgatcttgg aagtagtgaa gaatagcgtt    1140
catagctggg accatgttac tcagggcctc gtagaacttg gtttcatttt gatggattca    1200
tatgggccaa agaaggttct tgatggaaaa actattgaaa ccagcccaag tctttctaga    1260
atgccaaacc agcatgcatg taagctcgga gctaatatcc tgttggaaac ttttaagatc    1320
catgagatga tcagacaaga aattttggag caggtcctca acagggttgt taccagagca    1380
tcttctccca tcagtcattt cttagacctg ctttcaaata tcgtcatgta tgcaccctta    1440
gttcttcaaa gttgttcttc taaagtcaca gaagcttttg actatttgtc ctttctgccc    1500
cttcagactg tacaaaggct gcttaaggca gtgcagcccc ttctcaaagt cagcatgtca    1560
atgagagact gcttgatact tgtccttcgg aaagctatgt ttgccaacca gcttgatgcc    1620
cgaaaatctg cagttgctgg gtttttgctg ctcctgaaga actttaaagt tttaggcagc    1680
ctgtcatcct ctcagtgcag tcagtctctc agtgtcagtc aggttcatgt ggatgttcac    1740
agccattaca attctgtcgc caatgaaact tttgccttg agatcatgga tagtttgagg     1800
agatgcttaa gccagcaagc tgatgttcga ctcatgcttt atgaggggtt ttatgatgtt    1860
cttcgaagga actctcagct ggctaattca gtcatgcaaa ctctgctctc acagttaaaa    1920
cagttctatg agccaaaacc tgatctgctg cctcctctga aattagatgc ttgtattctg    1980
acccaaggag ataagatctc tctacaagaa ccactggatt atctgctgtg ttgtattcag    2040
cattgtttgg cctggtataa gaatacagtc ataccettac agcagggaga ggaggaagag    2100
gaggaggaag aggcattcta cgaagaccta gatgatatat tggagtccat tactaataga    2160
atgattaaga gtgagctgga agactttgaa ctggataaat cagcagattt ttctcagagc    2220
accagtattg gcataaaaaa taatatctct gcttttcttg tgatgggagt ttgtgaggtt    2280
ttaatagaat acaatttctc cataagtagt ttcagtaaga ataggtttga ggacattctg    2340
agcttattta tgtgttacaa aaaactctct gacattctta atgaaaaagc gggtaaagcc    2400
aaaactaaaa tggccaacaa gacaagtgat agtcttttgt ccatgaaatt tgtgtccagt    2460
cttctcactg ctcttttcag gtccagcaat gagtttatgc gctatgcagt gaatgtagct    2520
ctgcagaaag tacagcagct aaaggaaaca gggcatgtga gtggccctga tggccaaaac    2580
ccagaaaaga tctttcagaa cctctgtgac ataactcgag tcttgctatg gagatacact    2640
tcaattccta cttcagtgga agagtcggga aagaaagaga aaggaaagag catctcactg    2700
```

Figure 11b (continued)

```
ctgtgcttgg agggttaca gaaaatattc agtgctgtgc aacagttcta tcagcccaag    2760
attcagcagt ttctcagagc tctggatgtc acagataagg aaggagaaga gagagaagat    2820
gcagatgtca gtgtcactca gagaacagca ttccagatcc ggcaatttca gaggtccttg    2880
ttgaatttac ttagcagtca agaggaagat tttaatagca aagaagccct cctgctagtc    2940
acggttctta ccagtttgtc caagttactg gagccctcct ctcctcagtt tgtgcagatg    3000
ttatcctgga catcaaagat ttgcaaggaa aacagccggg aggatgcctt gttttgcaag    3060
agcttgatga acttgctctt cagcctgcat gtttcgtata agagtcctgt cattctgctg    3120
cgtgacttgt cccaggatat ccacgggcat ctgggagata tagaccagga tgtagaggtg    3180
gagaaaacaa accactttgc aatagtgaat ttgagaacgg ctgcccccac tgtctgttta    3240
cttgttctga gtcaggccga gaaggttcta gaagaagtgg actggctaat caccaagctt    3300
aagggacaag tgagccaaga aaccttatca gaagaggcct cttctcaggc aaccctacca    3360
aatcagcctg ttgagaaagc tatcatcatg caactgggaa ctctgcttac atttttccac    3420
gagctggtgc agacagctct gccatcaggc agctgtgtgg acaccttgtt aaaggacttg    3480
tgcaaaatgt acaccacact tacagccctt gtcagatatt atctccaggt gtgtcagagc    3540
tccggaggaa tcccaaaaaa tatggaaaag ctggtgaagc tgtctggttc tcatctgacc    3600
cccctgtgtt attctttcat ttcttacgta cagaataaga gtaagagcct gaactatacg    3660
ggagagaaaa aggagaaacc tgctgccgtt gccacagcca tggccagagt tcttcgggaa    3720
accaagccaa tccctaacct catctttgcc atagaacagt atgaaaaatt tctcatccac    3780
ctttctaaga agtccaaggt gaacctgatg cagcacatga agctcagcac ctcacgagac    3840
ttcaagatca aaggaaacat cctagacatg gttcttcgag aggatggcga agatgaaaat    3900
gaagagggca ctgcatcaga gcatgggga cagaacaaag aaccagccaa gaagaaaagg    3960
aaaaaataaa tgaaatgcct gagttaatgt g                                   3991
```

>83P4B8 v.4 (SEQ ID NO:117).

```
cggagttctg tgatatgagc aacaatggac cagaagattt tatctctagc agcagaaaaa      60
acagcagaca aactgcaaga atttcttcaa accctgagag aaggtgattt gactaatctc     120
cttcagaatc aagcagtgaa aggaaaagtt gctggagcac tcctgagagc catcttcaaa     180
ggttccccct gctctgagga agctggaaca cttaggagac gtaagatata cacttgttgt     240
atccagttgg tggaatcggg ggatttgcag aaagaaatag tgtctgagat cataggatta     300
ctgatgctgg aggctcacca ttttccagga ccattattgg ttgaattagc caatgagttt     360
attagtgctg tcagagaagg cagcctagtg aatggaaaat ctttggagtt actacctatc     420
attctcactg ccctggctac gaaaaaggaa aatctggctt atggaaaagg tgtactgagt     480
ggggaagaat gtaagaaaca gttgattaac accctgtgtt ctggcaggtg ggatcagcaa     540
tatgtaatcc aacacacctc catgttcaag gatgtccctc tgactgcaga agaggtggaa     600
tttgtggtgg aaaaagcatt gagcatgttc tccaagatga atcttcaaga aataccacct     660
ttggtctatc agcttctggt tctctcctcc aagggaagca gaaagagtgt tttggaagga     720
atcatagcct tcttcagtgc actagataag cagcacaatg aggaacagag tggtgacgag     780
ctattggatg ttgtcactgt gccatcaggt gaacttcgtc atgtggaagg caccattatt     840
```

Figure 11b (continued)

ctacacattg tgtttgccat caaattggac tatgaactag gcagagaact cgtgaaacac 900
ttaaaggtag gacagcaagg agattccaat aataacttaa gtcccttcag cattgctctt 960
cttctgtctg taacaagaat acaaagattt caggaccagg tgcttgatct tttaaagact 1020
tcggttgtaa agagctttaa ggatcttcaa ctcctccaag gctcaaaatt tcttcagaat 1080
ctagttcctc atagatctta tgtttcaacc atgatcttgg aagtagtgaa gaatagcgtt 1140
catagctggg accatgttac tcagggcctc gtagaacttg gtttcatttt gatggattca 1200
tatgggccaa agaaggttct tgatggaaaa actattgaaa ccagcccaag tctttctaga 1260
atgccaaacc agcatgcatg taagctcgga gctaatatcc tgttggaaac ttttaagatc 1320
catgagatga tcagacaaga aattttggag caggtcctca acagggttgt taccagagca 1380
tcttctccca tcagtcattt cttagacctg ctttcaaata tcgtcatgta tgcaccctta 1440
gttcttcaaa gttgttcttc taaagtcaca gaagcttttg actatttgtc ctttctgccc 1500
cttcagactg tacaaaggct gcttaaggca gtgcagcccc ttctcaaagt cagcatgtca 1560
atgagagact gcttgatact tgtccttcgg aaagctatgt ttgccaacca gcttgatgcc 1620
cgaaaatctg cagttgctgg gtttttgctg ctcctgaaga actttaaagt tttaggcagc 1680
ctgtcatcct ctcagtgcag tcagtctctc agtgtcagtc aggttcatgt ggatgttcac 1740
agccattaca attctgtcgc caatgaaact tttgccttg agatcatgga tagtttgagg 1800
agatgcttaa gccagcaagc tgatgttcga ctcatgcttt atgaggggtt ttatgatgtt 1860
cttcgaagga actctcagct ggctaattca gtcatgcaaa ctctgctctc acagttaaaa 1920
cagttctatg agccaaaacc tgatctgctg cctcctctga aattagatgc ttgtattctg 1980
acccaaggag ataagatctc tctacaagaa ccactggatt atctgctgtg ttgtattcag 2040
cattgtttgg cctggtataa gaatacagtc ataccttac agcagggaga ggaggaagag 2100
gaggaggaag aggcattcta cgaagaccta gatgatatat tggagtccat tactaataga 2160
atgattaaga gtgagctgga agactttgaa ctggataaat cagcagattt ttctcagagc 2220
accagtattg gcataaaaaa taatatctct gcttttcttg tgatgggagt ttgtgaggtt 2280
ttaatagaat acaatttctc cataagtagt ttcagtaaga ataggtttga ggacattctg 2340
agcttattta tgtgttacaa aaaactctct gacattctta atgaaaaagc gggtaaagcc 2400
aaaactaaaa tggccaacaa gacaagtgat agtcttttgt ccatgaaatt tgtgtccagt 2460
cttctcactg ctcttttcag agtcttgcta tggagataca cttcaattcc tacttcagtg 2520
gaagagtcgg gaaagaaaga gaaaggaaag agcatctcac tgctgtgctt ggagggttta 2580
cagaaaatat tcagtgctgt gcaacagttc tatcagccca agattcagca gtttctcaga 2640
gctctggatg tcacagataa ggaaggagaa gagagagaag atgcagatgt cagtgtcact 2700
cagagaacag cattccagat ccggcaattt cagaggtcct tgttgaattt acttagcagt 2760
caagaggaag attttaatag caaagaagcc ctcctgctag tcacggttct taccagtttg 2820
tccaagttac tggagccctc ctctcctcag tttgtgcaga tgttatcctg gacatcaaag 2880
atttgcaagg aaaacagccg ggaggatgcc ttgttttgca agagcttgat gaacttgctc 2940
ttcagcctgc atgtttcgta taagagtcct gtcattctgc tgcgtgactt gtcccaggat 3000
atccacgggc atctgggaga tatagaccag gatgtagagg tggagaaaac aaaccacttt 3060
gcaatagtga atttgagaac ggctgccccc actgtctgtt tacttgttct gagtcaggcc 3120
gagaaggttc tagaagaagt ggactggcta atcaccaagc ttaagggaca agtgagccaa 3180

Figure 11b (continued)

```
gaaaccttat cagaagaggc ctcttctcag gcaaccctac caaatcagcc tgttgagaaa    3240
gctatcatca tgcaactggg aactctgctt acatttttcc acgagctggt gcagacagct    3300
ctgccatcag gcagctgtgt ggacaccttg ttaaaggact tgtgcaaaat gtacaccaca    3360
cttacagccc ttgtcagata ttatctccag gtgtgtcaga gctccggagg aatcccaaaa    3420
aatatggaaa agctggtgaa gctgtctggt tctcatctga ccccctgtg ttattctttc    3480
atttcttacg tacagaataa gagtaagagc ctgaactata cgggagagaa aaaggagaaa    3540
cctgctgccg ttgccacagc catggccaga gttcttcggg aaaccaagcc aatccctaac    3600
ctcatctttg ccatagaaca gtatgaaaaa tttctcatcc acctttctaa gaagtccaag    3660
gtgaacctga tgcagcacat gaagctcagc acctcacgag acttcaagat caaaggaaac    3720
atcctagaca tggttcttcg agaggatggc gaagatgaaa atgaagaggg cactgcatca    3780
gagcatgggg gacagaacaa agaaccagcc aagaagaaaa ggaaaaaata aatgaaatgc    3840
ctgagttaat gtg                                                       3853
```

>83P4B8 v.5 (SEQ ID NO:118).

```
cggagttctg tgatatgagc aacaatggac cagaagattt tatctctagc agcagaaaaa      60
acagcagaca aactgcaaga atttcttcaa accctgagag aaggtgattt gactaatctc     120
cttcagaatc aagcagtgaa aggaaaagtt gctggagcac tcctgagagc catcttcaaa     180
ggttccccct gctctgagga agctggaaca cttaggagac gtaagatata cacttgttgt     240
atccagttgg tggaatcggg ggatttgcag aaagaaatag tgtctgagat cataggatta     300
ctgatgctgg aggctcacca ttttccagga ccattattgg ttgaattagc caatgagttt     360
attagtgctg tcagagaagg cagcctagtg aatggaaaat ctttggagtt actacctatc     420
attctcactg ccctggctac gaaaaaggaa aatctggctt atggaaaagg tgtactgagt     480
ggggaagaat gtaagaaaca gttgattaac accctgtgtt ctggcaggtg ggatcagcaa     540
tatgtaatcc aacacacctc catgttcaag gatgtccctc tgactgcaga agaggtggaa     600
tttgtggtgg aaaaagcatt gagcatgttc tccaagatga atcttcaaga aataccacct     660
ttggtctatc agcttctggt tctctcctcc aagggaagca gaaagagtgt tttggaagga     720
atcatagcct tcttcagtgc actagataag cagcacaatg aggaacagag tggtgacgag     780
ctattggatg ttgtcactgt gccatcaggt gaacttcgtc atgtggaagg caccattatt     840
ctacacattg tgtttgccat caaattggac tatgaactag gcagagaact cgtgaaacac     900
ttaaaggtag gacagcaagg agattccaat aataacttaa gtcccttcag cattgctctt     960
cttctgtctg taacaagaat acaaagattt caggaccagg tgcttgatct tttaaagact    1020
tcggttgtaa agagctttaa ggatcttcaa ctcctccaag gctcaaaatt tcttcagaat    1080
ctagttcctc atagatctta tgtttcaacc atgatcttgg aagtagtgaa gaatagcgtt    1140
catagctggg accatgttac tcagggcctc gtagaacttg gtttcatttt gatggattca    1200
tatgggccaa agaaggttct tgatggaaaa actattgaaa ccagcccaag tctttctaga    1260
atgccaaacc agcatgcatg taagctcgga gctaatatcc tgttggaaac ttttaagatc    1320
catgagatga tcagacaaga aatttggag caggtcctca acagggttgt taccagagca    1380
tcttctccca tcagtcattt cttagacctg ctttcaaata tcgtcatgta tgcaccctta    1440
```

Figure 11b (continued)

```
gttcttcaaa gttgttcttc taaagtcaca gaagcttttg actatttgtc ctttctgccc     1500
cttcagactg tacaaaggct gcttaaggca gtgcagcccc ttctcaaagt cagcatgtca     1560
atgagagact gcttgatact tgtccttcgg aaagctatgt ttgccaacca gcttgatgcc     1620
cgaaaatctg cagttgctgg gtttttgctg ctcctgaaga actttaaagt tttaggcagc     1680
ctgtcatcct ctcagtgcag tcagtctctc agtgtcagtc aggttcatgt ggatgttcac     1740
agccattaca attctgtcgc caatgaaact ttttgccttg agatcatgga tagtttgagg     1800
agatgcttaa gccagcaagc tgatgttcga ctcatgcttt atgaggggtt ttatgatgtt     1860
cttcgaagga actctcagct ggctaattca gtcatgcaaa ctctgctctc acagttaaaa     1920
cagttctatg agccaaaacc tgatctgctg cctcctctga aattagatgc ttgtattctg     1980
acccaaggag ataagatctc tctacaagaa ccactggatt atctgctgtg ttgtattcag     2040
cattgtttgg cctggtataa gaatacagtc ataccettac agcagggaga ggaggaagag     2100
gaggaggaag aggcattcta cgaagaccta gatgatatat tggagtccat tactaataga     2160
atgattaaga gtgagctgga agactttgaa ctggataaat cagcagattt ttctcagagc     2220
accagtattg gcataaaaaa taatatctct gcttttcttg tgatgggagt ttgtgaggtt     2280
ttaatagaat acaatttctc cataagtagt ttcagtaaga ataggtttga ggacattctg     2340
agcttattta tgtgttacaa aaaactctct gacattctta atgaaaaagc gggtaaagcc     2400
aaaactaaaa tggccaacaa gacaagtgat agtcttttgt ccatgaaatt tgtgtccagt     2460
cttctcactg ctcttttcag ggatagtatc caaagccacc aagaaagcct ttctgttctc     2520
aggtccagca atgagtttat gcgctatgca gtgaatgtag ctctgcagaa agtacagcag     2580
ctaaaggaaa cagggcatgt gagtggccct gatggccaaa acccagaaaa gatctttcag     2640
aacctctgtg acataactcg agtcttgcta tggagataca cttcaattcc tacttcagtg     2700
gaagagtcgg gaaagaaaga gaaaggaaag agcatctcac tgctgtgctt ggagggttta     2760
cagaaaatat tcagtgctgt gcaacagttc tatcagccca agattcagca gtttctcaga     2820
gctctggatg tcacagataa ggaaggagaa gagagagaag atgcagatgt cagtgtcact     2880
cagagaacag cattccagat ccggcaattt cagaggtcct tgttgaattt acttagcagt     2940
caagaggaag atttaaatag caaagaagcc ctcctgctag tcacggttct taccagtttg     3000
tccaagttac tggagccctc ctctcctcag tttgtgcaga tgttatcctg gacatcaaag     3060
atttgcaagg aaaacagccg ggaggatgcc ttgttttgca agagcttgat gaacttgctc     3120
ttcagcctgc atgtttcgta taagagtcct gtcattctgc tgcgtgactt gtcccaggat     3180
atccacgggc atctgggaga tatagaccag gatgtagagg tggagaaaac aaaccacttt     3240
gcaatagtga atttgagaac ggctgccccc actgtctgtt tacttgttct gagtcaggcc     3300
gagaaggttc tagaagaagt ggactggcta atcaccaagc ttaagggaca agtgagccaa     3360
gaaaccttat cagtatctcc aggtgtgtca gagctccgga ggaatcccaa aaaatatgga     3420
aaagctggtg aagctgtctg gttctcatct gacccccctg tgttattctt tcatttctta     3480
cgtacagaat aagagtaaga gcctgaacta tacgggagag aaaaaggaga aacctgctgc     3540
cgttgccaca gccatggcca gagttcttcg ggaaaccaag ccaatcccta acctcatctt     3600
tgccatagaa cagtatgaaa aatttctcat ccacctttct aagaagtcca aggtgaacct     3660
gatgcagcac atgaagctca gcacctcacg agacttcaag atcaaaggaa acatcctaga     3720
catggttctt cgagaggatg gcgaagatga aaatgaagag ggcactgcat cagagcatgg     3780
```

Figure 11b (continued)

```
gggacagaac aaagaaccag ccaagaagaa aaggaaaaaa taaatgaaat gcctgagtta    3840
atgtg                                                                3845
```

>83P4B8 v.6 (SEQ ID NO:119).

```
cggagttctg tgatatgagc aacaatggac cagaagattt tatctctagc agcagaaaaa      60
acagcagaca aactgcaaga atttcttcaa accctgagag aaggtgattt gactaatctc     120
cttcagaatc aagcagtgaa aggaaaagtt gctggagcac tcctgagagc catcttcaaa     180
ggttccccct gctctgagga agctggaaca cttaggagac gtaagatata cacttgttgt     240
atccagttgg tggaatcggg ggatttgcag aaagaaatag tgtctgagat cataggatta     300
ctgatgctgg aggctcacca ttttccagga ccattattgg ttgaattagc caatgagttt     360
attagtgctg tcagagaagg cagcctagtg aatggaaaat ctttggagtt actacctatc     420
attctcactg ccctggctac gaaaaaggaa aatctggctt atggaaaagg tgtactgagt     480
ggggaagaat gtaagaaaca gttgattaac accctgtgtt ctggcaggtg ggatcagcaa     540
tatgtaatcc aacacacctc catgttcaag gatgtccctc tgactgcaga agaggtggaa     600
tttgtggtgg aaaaagcatt gagcatgttc tccaagatga atcttcaaga aataccacct     660
ttggtctatc agcttctggt tctctcctcc aagggaagca gaaagagtgt tttggaagga     720
atcatagcct tcttcagtgc actagataag cagcacaatg aggaacagag tggtgacgag     780
ctattggatg ttgtcactgt gccatcaggt gaacttcgtc atgtggaagg caccattatt     840
ctacacattg tgtttgccat caaattggac tatgaactag gcagagaact cgtgaaacac     900
ttaaaggtag gacagcaagg agattccaat aataacttaa gtcccttcag cattgctctt     960
cttctgtctg taacaagaat acaaagattt caggaccagg tgcttgatct tttaaagact    1020
tcggttgtaa agagctttaa ggatcttcaa ctcctccaag gctcaaaatt tcttcagaat    1080
ctagttcctc atagatctta tgtttcaacc atgatcttgg aagtagtgaa gaatagcgtt    1140
catagctggg accatgttac tcagggcctc gtagaacttg gtttcatttt gatggattca    1200
tatgggccaa agaaggttct tgatggaaaa actattgaaa ccagcccaag tctttctaga    1260
atgccaaacc agcatgcatg taagctcgga gctaatatcc tgttggaaac ttttaagatc    1320
catgagatga tcagacaaga aattttggag caggtcctca acagggttgt taccagagca    1380
tcttctccca tcagtcattt cttagacctg ctttcaaata tcgtcatgta tgcaccctta    1440
gttcttcaaa gttgttcttc taaagtcaca gaagcttttg actatttgtc ctttctgccc    1500
cttcagactg tacaaaggct gcttaaggca gtgcagcccc ttctcaaagt cagcatgtca    1560
atgagagact gcttgatact tgtccttcgg aaagctatgt ttgccaacca gcttgatgcc    1620
cgaaaatctg cagttgctgg gtttttgctg ctcctgaaga actttaaagt tttaggcagc    1680
ctgtcatcct ctcagtgcag tcagtctctc agtgtcagtc aggttcatgt ggatgttcac    1740
agccattaca attctgtcgc caatgaaact tttgccttgg agatcatgga tagtttgagg    1800
agatgcttaa gccagcaagc tgatgttcga ctcatgcttt atgaggggtt ttatgatgtt    1860
cttcgaagga actctcagct ggctaattca gtcatgcaaa ctctgctctc acagttaaaa    1920
cagttctatg agccaaaacc tgatctgctg cctcctctga aattagatgc ttgtattctg    1980
acccaaggag ataagatctc tctacaagaa ccactggatt atctgctgtg ttgtattcag    2040
```

Figure 11b (continued)

```
cattgtttgg cctggtataa gaatacagtc ataccccttac agcagggaga ggaggaagag 2100
gaggaggaag aggcattcta cgaagaccta gatgatatat tggagtccat tactaataga 2160
atgattaaga gtgagctgga agactttgaa ctggataaat cagcagattt ttctcagagc 2220
accagtattg gcataaaaaa taatatctct gcttttcttg tgatgggagt ttgtgaggtt 2280
ttaatagaat acaatttctc cataagtagt ttcagtaaga ataggtttga ggacattctg 2340
agcttattta tgtgttacaa aaaactctct gacattctta atgaaaaagc gggtaaagcc 2400
aaaactaaaa tggccaacaa gacaagtgat agtcttttgt ccatgaaatt tgtgtccagt 2460
cttctcactg ctcttttcag agtcttgcta tggagataca cttcaattcc tacttcagtg 2520
gaagagtcgg gaaagaaaga gaaaggaaag agcatctcac tgctgtgctt ggagggttta 2580
cagaaaatat tcagtgctgt gcaacagttc tatcagccca agattcagca gtttctcaga 2640
gctctggatg tcacagataa ggaaggagaa gagagagaag atgcagatgt cagtgtcact 2700
cagagaacag cattccagat ccggcaattt cagaggtcct tgttgaattt acttagcagt 2760
caagaggaag attttaatag caaagaagcc ctcctgctag tcacggttct taccagtttg 2820
tccaagttac tggagccctc ctctcctcag tttgtgcaga tgttatcctg gacatcaaag 2880
atttgcaagg aaaacagccg ggaggatgcc ttgttttgca agagcttgat gaacttgctc 2940
ttcagcctgc atgtttcgta taagagtcct gtcattctgc tgcgtgactt gtcccaggat 3000
atccacgggc atctgggaga tatagaccag gatgtagagg tggagaaaac aaaccacttt 3060
gcaatagtga atttgagaac ggctgccccc actgtctgtt tacttgttct gagtcaggcc 3120
gagaaggttc tagaagaagt ggactggcta atcaccaagc ttaagggaca agtgagccaa 3180
gaaaccttat cagtatctcc aggtgtgtca gagctccgga ggaatcccaa aaaatatgga 3240
aaagctggtg aagctgtctg gttctcatct gaccccccctg tgttattctt tcatttctta 3300
cgtacagaat aagagtaaga gcctgaacta tacgggagag aaaaaggaga aacctgctgc 3360
cgttgccaca gccatggcca gagttcttcg ggaaaccaag ccaatcccta acctcatctt 3420
tgccatagaa cagtatgaaa aatttctcat ccacctttct aagaagtcca aggtgaacct 3480
gatgcagcac atgaagctca gcacctcacg agacttcaag atcaaaggaa acatcctaga 3540
catggttctt cgagaggatg gcgaagatga aaatgaagag ggcactgcat cagagcatgg 3600
gggacagaac aaagaaccag ccaagaagaa aaggaaaaaa taaatgaaat gcctgagtta 3660
atgtg 3665
```

Figure 12b Protein sequences of transcript variants of 83P4B8
>83P4B8 v.2 (SEQ ID NO:120).

```
MFKDVPLTAE EVEFVVEKAL SMFSKMNLQE IPPLVYQLLV LSSKGSRKSV LEGIIAFFSA      60
LDKQHNEEQS GDELLDVVTV PSGELRHVEG TIILHIVFAI KLDYELGREL VKHLKVGQQG     120
DSNNNLSPFS IALLLSVTRI QRFQDQVLDL LKTSVVKSFK DLQLLQGSKF LQNLVPHRSY     180
VSTMILEVVK NSVHSWDHVT QGLVELGFIL MDSYGPKKVL DGKTIETSPS LSRMPNQHAC     240
KLGANILLET FKIHEMIRQE ILEQVLNRVV TRASSPISHF LDLLSNIVMY APLVLQSCSS     300
KVTEAFDYLS FLPLQTVQRL LKAVQPLLKV SMSMRDCLIL VLRKAMFANQ LDARKSAVAG     360
FLLLLKNFKV LGSLSSSQCS QSLSVSQVHV DVHSHYNSVA NETFCLEIMD SLRRCLSQQA     420
DVRLMLYEGF YDVLRRNSQL ANSVMQTLLS QLKQFYEPKP DLLPPLKLDA CILTQGDKIS     480
LQEPLDYLLC CIQHCLAWYK NTVIPLQQGE EEEEEEAFY EDLDDILESI TNRMIKSELE     540
DFELDKSADF SQSTSIGIKN NISAFLVMGV CEVLIEYNFS ISSFSKNRFE DILSLFMCYK     600
KLSDILNEKA GKAKTKMANK TSDSLLSMKF VSSLLTALFR DSIQSHQESL SVLRSSNEFM     660
RYAVNVALQK VQQLKETGHV SGPDGQNPEK IFQNLCDITR VLLWRYTSIP TSVEESGKKE     720
KGKSISLLCL EGLQKIFSAV QQFYQPKIQQ FLRALDVTDK EGEEREDADV SVTQRTAFQI     780
RQFQRSLLNL LSSQEEDFNS KEALLLVTVL TSLSKLLEPS SPQFVQMLSW TSKICKENSR     840
EDALFCKSLM NLLFSLHVSY KSPVILLRDL SQDIHGHLGD IDQDVEVEKT NHFAIVNLRT     900
AAPTVCLLVL SQAEKVLEEV DWLITKLKGQ VSQETLSEEA SSQATLPNQP VEKAIIMQLG     960
TLLTFFHELV QTALPSGSCV DTLLKDLCKM YTTLTALVRY YLQVCQSSGG IPKNMEKLVK    1020
LSGSHLTPLC YSFISYVQNK SKSLNYTGEK KEKPAAVATA MARVLRETKP IPNLIFAIEQ    1080
YEKFLIHLSK KSKVNLMQHM KLSTSRDFKI KGNILDMVLR EDGEDENEEG TASEHGGQNK    1140
EPAKKKRKK                                                            1149
```

>83P4B8 v.3 (SEQ ID NO:121).

```
MDQKILSLAA EKTADKLQEF LQTLREGDLT NLLQNQAVKG KVAGALLRAI FKGSPCSEEA      60
GTLRRRKIYT CCIQLVESGD LQKEIVSEII GLLMLEAHHF PGPLLVELAN EFISAVREGS     120
LVNGKSLELL PIILTALATK KENLAYGKGV LSGEECKKQL INTLCSGRWD QQYVIQHTSM     180
FKDVPLTAEE VEFVVEKALS MFSKMNLQEI PPLVYQLLVL SSKGSRKSVL EGIIAFFSAL     240
DKQHNEEQSG DELLDVVTVP SGELRHVEGT IILHIVFAIK LDYELGRELV KHLKVGQQGD     300
SNNNLSPFSI ALLLSVTRIQ RFQDQVLDLL KTSVVKSFKD LQLLQGSKFL QNLVPHRSYV     360
STMILEVVKN SVHSWDHVTQ GLVELGFILM DSYGPKKVLD GKTIETSPSL SRMPNQHACK     420
LGANILLETF KIHEMIRQEI LEQVLNRVVT RASSPISHFL DLLSNIVMYA PLVLQSCSSK     480
VTEAFDYLSF LPLQTVQRLL KAVQPLLKVS MSMRDCLILV LRKAMFANQL DARKSAVAGF     540
LLLLKNFKVL GSLSSSQCSQ SLSVSQVHVD VHSHYNSVAN ETFCLEIMDS LRRCLSQQAD     600
VRLMLYEGFY DVLRRNSQLA NSVMQTLLSQ LKQFYEPKPD LLPPLKLDAC ILTQGDKISL     660
QEPLDYLLCC IQHCLAWYKN TVIPLQQGEE EEEEEAFYE DLDDILESIT NRMIKSELED     720
FELDKSADFS QSTSIGIKNN ISAFLVMGVC EVLIEYNFSI SSFSKNRFED ILSLFMCYKK     780
LSDILNEKAG KAKTKMANKT SDSLLSMKFV SSLLTALFRS SNEFMRYAVN VALQKVQQLK     840
ETGHVSGPDG QNPEKIFQNL CDITRVLLWR YTSIPTSVEE SGKKEKGKSI SLLCLEGLQK     900
```

Figure 12b (continued)

```
IFSAVQQFYQ PKIQQFLRAL DVTDKEGEER EDADVSVTQR TAFQIRQFQR SLLNLLSSQE    960
EDFNSKEALL LVTVLTSLSK LLEPSSPQFV QMLSWTSKIC KENSREDALF CKSLMNLLFS   1020
LHVSYKSPVI LLRDLSQDIH GHLGDIDQDV EVEKTNHFAI VNLRTAAPTV CLLVLSQAEK   1080
VLEEVDWLIT KLKGQVSQET LSEEASSQAT LPNQPVEKAI IMQLGTLLTF FHELVQTALP   1140
SGSCVDTLLK DLCKMYTTLT ALVRYYLQVC QSSGGIPKNM EKLVKLSGSH LTPLCYSFIS   1200
YVQNKSKSLN YTGEKKEKPA AVATAMARVL RETKPIPNLI FAIEQYEKFL IHLSKKSKVN   1260
LMQHMKLSTS RDFKIKGNIL DMVLREDGED ENEEGTASEH GGQNKEPAKK KRKK         1314
```

>83P4B8 v.4 (SEQ ID NO:122).

```
MDQKILSLAA EKTADKLQEF LQTLREGDLT NLLQNQAVKG KVAGALLRAI FKGSPCSEEA     60
GTLRRRKIYT CCIQLVESGD LQKEIVSEII GLLMLEAHRF PGPLLVELAN EFISAVREGS    120
LVNGKSLELL PIILTALATK KENLAYGKGV LSGEECKKQL INTLCSGRWD QQYVIQHTSM    180
FKDVPLTAEE VEFVVEKALS MFSKMNLQEI PPLVYQLLVL SSKGSRKSVL EGIIAFFSAL    240
DKQHNEEQSG DELLDVVTVP SGELRHVEGT IILHIVFAIK LDYELGRELV KHLKVGQQGD    300
SNNNLSPFSI ALLLSVTRIQ RFQDQVLDLL KTSVVKSFKD LQLLQGSKFL QNLVPHRSYV    360
STMILEVVKN SVHSWDHVTQ GLVELGFILM DSYGPKKVLD GKTIETSPSL SRMPNQHACK    420
LGANILLETF KIHEMIRQEI LEQVLNRVVT RASSPISHFL DLLSNIVMYA PLVLQSCSSK    480
VTEAFDYLSF LPLQTVQRLL KAVQPLLKVS MSMRDCLILV LRKAMFANQL DARKSAVAGF    540
LLLLKNFKVL GSLSSSQCSQ SLSVSQVHVD VHSHYNSVAN ETFCLEIMDS LRRCLSQQAD    600
VRLMLYEGFY DVLRRNSQLA NSVMQTLLSQ LKQFYEPKPD LLPPLKLDAC ILTQGDKISL    660
QEPLDYLLCC IQHCLAWYKN TVIPLQQGEE EEEEEAFYE DLDDILESIT NRMIKSELED    720
FELDKSADFS QSTSIGIKNN ISAFLVMGVC EVLIEYNFSI SSFSKNRFED ILSLFMCYKK    780
LSDILNEKAG KAKTKMANKT SDSLLSMKFV SSLLTALFRV LLWRYTSIPT SVEESGKKEK    840
GKSISLLCLE GLQKIFSAVQ QFYQPKIQQF LRALDVTDKE GEEREDADVS VTQRTAFQIR    900
QFQRSLLNLL SSQEEDFNSK EALLLVTVLT SLSKLLEPSS PQFVQMLSWT SKICKENSRE    960
DALFCKSLMN LLFSLHVSYK SPVILLRDLS QDIHGHLGDI DQDVEVEKTN HFAIVNLRTA   1020
APTVCLLVLS QAEKVLEEVD WLITKLKGQV SQETLSEEAS SQATLPNQPV EKAIIMQLGT   1080
LLTFFHELVQ TALPSGSCVD TLLKDLCKMY TTLTALVRYY LQVCQSSGGI PKNMEKLVKL   1140
SGSHLTPLCY SFISYVQNKS KSLNYTGEKK EKPAAVATAM ARVLRETKPI PNLIFAIEQY   1200
EKFLIHLSKK SKVNLMQHMK LSTSRDFKIK GNILDMVLRE DGEDENEEGT ASEHGGQNKE   1260
PAKKKRKK                                                            1268
```

>83P4B8 v.5 (SEQ ID NO:123).

```
MDQKILSLAA EKTADKLQEF LQTLREGDLT NLLQNQAVKG KVAGALLRAI FKGSPCSEEA     60
GTLRRRKIYT CCIQLVESGD LQKEIVSEII GLLMLEAHRF PGPLLVELAN EFISAVREGS    120
LVNGKSLELL PIILTALATK KENLAYGKGV LSGEECKKQL INTLCSGRWD QQYVIQHTSM    180
FKDVPLTAEE VEFVVEKALS MFSKMNLQEI PPLVYQLLVL SSKGSRKSVL EGIIAFFSAL    240
```

Figure 12b (continued)

```
DKQHNEEQSG DELLDVVTVP SGELRHVEGT IILHIVFAIK LDYELGRELV KHLKVGQQGD   300
SNNNLSPFSI ALLLSVTRIQ RFQDQVLDLL KTSVVKSFKD LQLLQGSKFL QNLVPHRSYV   360
STMILEVVKN SVHSWDHVTQ GLVELGFILM DSYGPKKVLD GKTIETSPSL SRMPNQHACK   420
LGANILLETF KIHEMIRQEI LEQVLNRVVT RASSPISHFL DLLSNIVMYA PLVLQSCSSK   480
VTEAFDYLSF LPLQTVQRLL KAVQPLLKVS MSMRDCLILV LRKAMFANQL DARKSAVAGF   540
LLLLKNFKVL GSLSSSQCSQ SLSVSQVHVD VHSHYNSVAN ETFCLEIMDS LRRCLSQQAD   600
VRLMLYEGFY DVLRRNSQLA NSVMQTLLSQ LKQFYEPKPD LLPPLKLDAC ILTQGDKISL   660
QEPLDYLLCC IQHCLAWYKN TVIPLQQGEE EEEEEEAFYE DLDDILESIT NRMIKSELED   720
FELDKSADFS QSTSIGIKNN ISAFLVMGVC EVLIEYNFSI SSFSKNRFED ILSLFMCYKK   780
LSDILNEKAG KAKTKMANKT SDSLLSMKFV SSLLTALFRD SIQSHQESLS VLRSSNEFMR   840
YAVNVALQKV QQLKETGHVS GPDGQNPEKI FQNLCDITRV LLWRYTSIPT SVEESGKKEK   900
GKSISLLCLE GLQKIFSAVQ QFYQPKIQQF LRALDVTDKE GEEREDADVS VTQRTAFQIR   960
QFQRSLLNLL SSQEEDFNSK EALLLVTVLT SLSKLLEPSS PQFVQMLSWT SKICKENSRE  1020
DALFCKSLMN LLFSLHVSYK SPVILLRDLS QDIHGHLGDI DQDVEVEKTN HFAIVNLRTA  1080
APTVCLLVLS QAEKVLEEVD WLITKLKGQV SQETLSVSPG VSELRRNPKK YGKAGEAVWF  1140
SSDPPVLFFH FLRTE                                                  1155
```

>83P4B8 v.6 (SEQ ID NO:124).

```
MDQKILSLAA EKTADKLQEF LQTLREGDLT NLLQNQAVKG KVAGALLRAI FKGSPCSEEA    60
GTLRRRKIYT CCIQLVESGD LQKEIVSEII GLLMLEAHHF PGPLLVELAN EFISAVREGS   120
LVNGKSLELL PIILTALATK KENLAYGKGV LSGEECKKQL INTLCSGRWD QQYVIQHTSM   180
FKDVPLTAEE VEFVVEKALS MFSKMNLQEI PPLVYQLLVL SSKGSRKSVL EGIIAFFSAL   240
DKQHNEEQSG DELLDVVTVP SGELRHVEGT IILHIVFAIK LDYELGRELV KHLKVGQQGD   300
SNNNLSPFSI ALLLSVTRIQ RFQDQVLDLL KTSVVKSFKD LQLLQGSKFL QNLVPHRSYV   360
STMILEVVKN SVHSWDHVTQ GLVELGFILM DSYGPKKVLD GKTIETSPSL SRMPNQHACK   420
LGANILLETF KIHEMIRQEI LEQVLNRVVT RASSPISHFL DLLSNIVMYA PLVLQSCSSK   480
VTEAFDYLSF LPLQTVQRLL KAVQPLLKVS MSMRDCLILV LRKAMFANQL DARKSAVAGF   540
LLLLKNFKVL GSLSSSQCSQ SLSVSQVHVD VHSHYNSVAN ETFCLEIMDS LRRCLSQQAD   600
VRLMLYEGFY DVLRRNSQLA NSVMQTLLSQ LKQFYEPKPD LLPPLKLDAC ILTQGDKISL   660
QEPLDYLLCC IQHCLAWYKN TVIPLQQGEE EEEEEEAFYE DLDDILESIT NRMIKSELED   720
FELDKSADFS QSTSIGIKNN ISAFLVMGVC EVLIEYNFSI SSFSKNRFED ILSLFMCYKK   780
LSDILNEKAG KAKTKMANKT SDSLLSMKFV SSLLTALFRV LLWRYTSIPT SVEESGKKEK   840
GKSISLLCLE GLQKIFSAVQ QFYQPKIQQF LRALDVTDKE GEEREDADVS VTQRTAFQIR   900
QFQRSLLNLL SSQEEDFNSK EALLLVTVLT SLSKLLEPSS PQFVQMLSWT SKICKENSRE   960
DALFCKSLMN LLFSLHVSYK SPVILLRDLS QDIHGHLGDI DQDVEVEKTN HFAIVNLRTA  1020
APTVCLLVLS QAEKVLEEVD WLITKLKGQV SQETLSVSPG VSELRRNPKK YGKAGEAVWF  1080
SSDPPVLFFH FLRTE                                                  1095
```

Figure 13b Alignment of nucleotide sequences of 83P4B8 transcript variants (SEQ ID NOs:23, 115, 116, 117, 118, 119).

```
83P4B8v.3      CGGAGTTCTGTGATATGAGCAACAATGGACCAGAAGATTTTATCTCTAGCAGCAGAAAAA 60
83P4B8v.4      CGGAGTTCTGTGATATGAGCAACAATGGACCAGAAGATTTTATCTCTAGCAGCAGAAAAA 60
83P4B8v.2      CGGAGTTCTGTGATATGAGCAACAATGGACCAGAAGATTTTATCTCTAGCAGCAGAAAAA 60
83P4B8v.1      CGGAGTTCTGTGATATGAGCAACAATGGACCAGAAGATTTTATCTCTAGCAGCAGAAAAA 60
83P4B8v.5      CGGAGTTCTGTGATATGAGCAACAATGGACCAGAAGATTTTATCTCTAGCAGCAGAAAAA 60
83P4B8v.6      CGGAGTTCTGTGATATGAGCAACAATGGACCAGAAGATTTTATCTCTAGCAGCAGAAAAA 60
               ************************************************************

83P4B8v.3      ACAGCAGACAAACTGCAAGAATTTCTTCAAACCCTGAGAGAAGGTGATTTGACTAATCTC 120
83P4B8v.4      ACAGCAGACAAACTGCAAGAATTTCTTCAAACCCTGAGAGAAGGTGATTTGACTAATCTC 120
83P4B8v.2      ACAGCAGACAAACTGCAAGAATTTCTTCAAACCCTGAGAGAAGGTGATTTGACTAATCTC 120
83P4B8v.1      ACAGCAGACAAACTGCAAGAATTTCTTCAAACCCTGAGAGAAGGTGATTTGACTAATCTC 120
83P4B8v.5      ACAGCAGACAAACTGCAAGAATTTCTTCAAACCCTGAGAGAAGGTGATTTGACTAATCTC 120
83P4B8v.6      ACAGCAGACAAACTGCAAGAATTTCTTCAAACCCTGAGAGAAGGTGATTTGACTAATCTC 120
               ************************************************************

83P4B8v.3      CTTCAGAATCAAGCAGTGAAAGGAAAAGTTGCTGGAGCACTCCTGAGAGCCATCTTCAAA 180
83P4B8v.4      CTTCAGAATCAAGCAGTGAAAGGAAAAGTTGCTGGAGCACTCCTGAGAGCCATCTTCAAA 180
83P4B8v.2      CTTCAGAATCAAGCAGTGAAAGGAAAAGTTGCTGGAGCACTCCTGAGAGCCATCTTCAAA 180
83P4B8v.1      CTTCAGAATCAAGCAGTGAAAGGAAAAGTTGCTGGAGCACTCCTGAGAGCCATCTTCAAA 180
83P4B8v.5      CTTCAGAATCAAGCAGTGAAAGGAAAAGTTGCTGGAGCACTCCTGAGAGCCATCTTCAAA 180
83P4B8v.6      CTTCAGAATCAAGCAGTGAAAGGAAAAGTTGCTGGAGCACTCCTGAGAGCCATCTTCAAA 180
               ************************************************************

83P4B8v.3      GGTTCCCCCTGCTCTGAGGAAGCTGGAACACTTAGGAGACGTAAGATATACACTTGTTGT 240
83P4B8v.4      GGTTCCCCCTGCTCTGAGGAAGCTGGAACACTTAGGAGACGTAAGATATACACTTGTTGT 240
83P4B8v.2      GGTTCCCCCTGCTCTGAGGAAGCTGGAACACTTAGGAGACGTAAGATATACACTTGTTGT 240
83P4B8v.1      GGTTCCCCCTGCTCTGAGGAAGCTGGAACACTTAGGAGACGTAAGATATACACTTGTTGT 240
83P4B8v.5      GGTTCCCCCTGCTCTGAGGAAGCTGGAACACTTAGGAGACGTAAGATATACACTTGTTGT 240
83P4B8v.6      GGTTCCCCCTGCTCTGAGGAAGCTGGAACACTTAGGAGACGTAAGATATACACTTGTTGT 240
               ************************************************************

83P4B8v.3      ATCCAGTTGGTGGAATCGGGGGATTTGCAGAAAGAAATAGTGTCTGAGATCATAGGATTA 300
83P4B8v.4      ATCCAGTTGGTGGAATCGGGGGATTTGCAGAAAGAAATAGTGTCTGAGATCATAGGATTA 300
83P4B8v.2      ATCCAGTTGGTGGAATCGGGGGATTTGCAGAAAGAAATAGTGTCTGAGATCATAGGATTA 300
83P4B8v.1      ATCCAGTTGGTGGAATCGGGGGATTTGCAGAAAGAAATAGTGTCTGAGATCATAGGATTA 300
83P4B8v.5      ATCCAGTTGGTGGAATCGGGGGATTTGCAGAAAGAAATAGTGTCTGAGATCATAGGATTA 300
```

Figure 13b (continued)

```
83P4B8v.6     ATCCAGTTGGTGGAATCGGGGGATTTGCAGAAAGAAATAGTGTCTGAGATCATAGGATTA 300
              ************************************************************

83P4B8v.3     CTGATGCTGGAGGCTCACCATTTTCCAGGACCATTATTGGTTGAATTAGCCAATGAGTTT 360
83P4B8v.4     CTGATGCTGGAGGCTCACCATTTTCCAGGACCATTATTGGTTGAATTAGCCAATGAGTTT 360
83P4B8v.2     CTGATGCTGGAGGCTCACCATTTTCCAGGACCATTATTGGTTGAATTAGCCAATGAGTTT 360
83P4B8v.1     CTGATGCTGGAGGCTCACCATTTTCCAGGACCATTATTGGTTGAATTAGCCAATGAGTTT 360
83P4B8v.5     CTGATGCTGGAGGCTCACCATTTTCCAGGACCATTATTGGTTGAATTAGCCAATGAGTTT 360
83P4B8v.6     CTGATGCTGGAGGCTCACCATTTTCCAGGACCATTATTGGTTGAATTAGCCAATGAGTTT 360
              ************************************************************

83P4B8v.3     ATTAGTGCTGTCAGAGAAGGCAGCCTAGTGAATGGAAAATCTTTGGAGTTACTACCTATC 420
83P4B8v.4     ATTAGTGCTGTCAGAGAAGGCAGCCTAGTGAATGGAAAATCTTTGGAGTTACTACCTATC 420
83P4B8v.2     ATTAGTGCTGTCAGAGAAGGCAGCCTAGTGAATGGAAAATCTTTGGAGTTACTACCTATC 420
83P4B8v.1     ATTAGTGCTGTCAGAGAAGGCAGCCTAGTGAATGGAAAATCTTTGGAGTTACTACCTATC 420
83P4B8v.5     ATTAGTGCTGTCAGAGAAGGCAGCCTAGTGAATGGAAAATCTTTGGAGTTACTACCTATC 420
83P4B8v.6     ATTAGTGCTGTCAGAGAAGGCAGCCTAGTGAATGGAAAATCTTTGGAGTTACTACCTATC 420
              ************************************************************

83P4B8v.3     ATTCTCACTGCCCTGGCTACGAAAAAGGAAAATCTGGCTTATGGAAAAGGTGTACTGAGT 480
83P4B8v.4     ATTCTCACTGCCCTGGCTACGAAAAAGGAAAATCTGGCTTATGGAAAAGGTGTACTGAGT 480
83P4B8v.2     ATTCTCACTGCCCTGGCTACGAAAAAGGAAAATCTGGCTTATGGAAAAGGTG-------- 472
83P4B8v.1     ATTCTCACTGCCCTGGCTACGAAAAAGGAAAATCTGGCTTATGGAAAAGGTGTACTGAGT 480
83P4B8v.5     ATTCTCACTGCCCTGGCTACGAAAAAGGAAAATCTGGCTTATGGAAAAGGTGTACTGAGT 480
83P4B8v.6     ATTCTCACTGCCCTGGCTACGAAAAAGGAAAATCTGGCTTATGGAAAAGGTGTACTGAGT 480
              ****************************************************

83P4B8v.3     GGGGAAGAATGTAAGAAACAGTTGATTAACACCCTGTGTTCTGGCAGGTGGGATCAGCAA 540
83P4B8v.4     GGGGAAGAATGTAAGAAACAGTTGATTAACACCCTGTGTTCTGGCAGGTGGGATCAGCAA 540
83P4B8v.2     --------------------------------------------------GGATCAGCAA 482
83P4B8v.1     GGGGAAGAATGTAAGAAACAGTTGATTAACACCCTGTGTTCTGGCAGGTGGGATCAGCAA 540
83P4B8v.5     GGGGAAGAATGTAAGAAACAGTTGATTAACACCCTGTGTTCTGGCAGGTGGGATCAGCAA 540
83P4B8v.6     GGGGAAGAATGTAAGAAACAGTTGATTAACACCCTGTGTTCTGGCAGGTGGGATCAGCAA 540
                                                                **********

83P4B8v.3     TATGTAATCCAACACACCTCCATGTTCAAGGATGTCCCTCTGACTGCAGAAGAGGTGGAA 600
83P4B8v.4     TATGTAATCCAACACACCTCCATGTTCAAGGATGTCCCTCTGACTGCAGAAGAGGTGGAA 600
83P4B8v.2     TATGTAATCCAACACACCTCCATGTTCAAGGATGTCCCTCTGACTGCAGAAGAGGTGGAA 542
83P4B8v.1     TATGTAATCCAACACACCTCCATGTTCAAGGATGTCCCTCTGACTGCAGAAGAGGTGGAA 600
```

Figure 13b (continued)

```
83P4B8v.5     TATGTAATCCAACACACCTCCATGTTCAAGGATGTCCCTCTGACTGCAGAAGAGGTGGAA 600
83P4B8v.6     TATGTAATCCAACACACCTCCATGTTCAAGGATGTCCCTCTGACTGCAGAAGAGGTGGAA 600
              ************************************************************

83P4B8v.3     TTTGTGGTGGAAAAAGCATTGAGCATGTTCTCCAAGATGAATCTTCAAGAAATACCACCT 660
83P4B8v.4     TTTGTGGTGGAAAAAGCATTGAGCATGTTCTCCAAGATGAATCTTCAAGAAATACCACCT 660
83P4B8v.2     TTTGTGGTGGAAAAAGCATTGAGCATGTTCTCCAAGATGAATCTTCAAGAAATACCACCT 602
83P4B8v.1     TTTGTGGTGGAAAAAGCATTGAGCATGTTCTCCAAGATGAATCTTCAAGAAATACCACCT 660
83P4B8v.5     TTTGTGGTGGAAAAAGCATTGAGCATGTTCTCCAAGATGAATCTTCAAGAAATACCACCT 660
83P4B8v.6     TTTGTGGTGGAAAAAGCATTGAGCATGTTCTCCAAGATGAATCTTCAAGAAATACCACCT 660
              ************************************************************

83P4B8v.3     TTGGTCTATCAGCTTCTGGTTCTCTCCTCCAAGGGAAGCAGAAAGAGTGTTTTGGAAGGA 720
83P4B8v.4     TTGGTCTATCAGCTTCTGGTTCTCTCCTCCAAGGGAAGCAGAAAGAGTGTTTTGGAAGGA 720
83P4B8v.2     TTGGTCTATCAGCTTCTGGTTCTCTCCTCCAAGGGAAGCAGAAAGAGTGTTTTGGAAGGA 662
83P4B8v.1     TTGGTCTATCAGCTTCTGGTTCTCTCCTCCAAGGGAAGCAGAAAGAGTGTTTTGGAAGGA 720
83P4B8v.5     TTGGTCTATCAGCTTCTGGTTCTCTCCTCCAAGGGAAGCAGAAAGAGTGTTTTGGAAGGA 720
83P4B8v.6     TTGGTCTATCAGCTTCTGGTTCTCTCCTCCAAGGGAAGCAGAAAGAGTGTTTTGGAAGGA 720
              ************************************************************

83P4B8v.3     ATCATAGCCTTCTTCAGTGCACTAGATAAGCAGCACAATGAGGAACAGAGTGGTGACGAG 780
83P4B8v.4     ATCATAGCCTTCTTCAGTGCACTAGATAAGCAGCACAATGAGGAACAGAGTGGTGACGAG 780
83P4B8v.2     ATCATAGCCTTCTTCAGTGCACTAGATAAGCAGCACAATGAGGAACAGAGTGGTGACGAG 722
83P4B8v.1     ATCATAGCCTTCTTCAGTGCACTAGATAAGCAGCACAATGAGGAACAGAGTGGTGACGAG 780
83P4B8v.5     ATCATAGCCTTCTTCAGTGCACTAGATAAGCAGCACAATGAGGAACAGAGTGGTGACGAG 780
83P4B8v.6     ATCATAGCCTTCTTCAGTGCACTAGATAAGCAGCACAATGAGGAACAGAGTGGTGACGAG 780
              ************************************************************

83P4B8v.3     CTATTGGATGTTGTCACTGTGCCATCAGGTGAACTTCGTCATGTGGAAGGCACCATTATT 840
83P4B8v.4     CTATTGGATGTTGTCACTGTGCCATCAGGTGAACTTCGTCATGTGGAAGGCACCATTATT 840
83P4B8v.2     CTATTGGATGTTGTCACTGTGCCATCAGGTGAACTTCGTCATGTGGAAGGCACCATTATT 782
83P4B8v.1     CTATTGGATGTTGTCACTGTGCCATCAGGTGAACTTCGTCATGTGGAAGGCACCATTATT 840
83P4B8v.5     CTATTGGATGTTGTCACTGTGCCATCAGGTGAACTTCGTCATGTGGAAGGCACCATTATT 840
83P4B8v.6     CTATTGGATGTTGTCACTGTGCCATCAGGTGAACTTCGTCATGTGGAAGGCACCATTATT 840
              ************************************************************

83P4B8v.3     CTACACATTGTGTTTGCCATCAAATTGGACTATGAACTAGGCAGAGAACTCGTGAAACAC 900
83P4B8v.4     CTACACATTGTGTTTGCCATCAAATTGGACTATGAACTAGGCAGAGAACTCGTGAAACAC 900
83P4B8v.2     CTACACATTGTGTTTGCCATCAAATTGGACTATGAACTAGGCAGAGAACTCGTGAAACAC 842
```

Figure 13b (continued)

```
83P4B8v.1    CTACACATTGTGTTTGCCATCAAATTGGACTATGAACTAGGCAGAGAACTCGTGAAACAC 900
83P4B8v.5    CTACACATTGTGTTTGCCATCAAATTGGACTATGAACTAGGCAGAGAACTCGTGAAACAC 900
83P4B8v.6    CTACACATTGTGTTTGCCATCAAATTGGACTATGAACTAGGCAGAGAACTCGTGAAACAC 900
             ************************************************************

83P4B8v.3    TTAAAGGTAGGACAGCAAGGAGATTCCAATAATAACTTAAGTCCCTTCAGCATTGCTCTT 960
83P4B8v.4    TTAAAGGTAGGACAGCAAGGAGATTCCAATAATAACTTAAGTCCCTTCAGCATTGCTCTT 960
83P4B8v.2    TTAAAGGTAGGACAGCAAGGAGATTCCAATAATAACTTAAGTCCCTTCAGCATTGCTCTT 902
83P4B8v.1    TTAAAGGTAGGACAGCAAGGAGATTCCAATAATAACTTAAGTCCCTTCAGCATTGCTCTT 960
83P4B8v.5    TTAAAGGTAGGACAGCAAGGAGATTCCAATAATAACTTAAGTCCCTTCAGCATTGCTCTT 960
83P4B8v.6    TTAAAGGTAGGACAGCAAGGAGATTCCAATAATAACTTAAGTCCCTTCAGCATTGCTCTT 960
             ************************************************************

83P4B8v.3    CTTCTGTCTGTAACAAGAATACAAAGATTTCAGGACCAGGTGCTTGATCTTTTAAAGACT 1020
83P4B8v.4    CTTCTGTCTGTAACAAGAATACAAAGATTTCAGGACCAGGTGCTTGATCTTTTAAAGACT 1020
83P4B8v.2    CTTCTGTCTGTAACAAGAATACAAAGATTTCAGGACCAGGTGCTTGATCTTTTAAAGACT 962
83P4B8v.1    CTTCTGTCTGTAACAAGAATACAAAGATTTCAGGACCAGGTGCTTGATCTTTTAAAGACT 1020
83P4B8v.5    CTTCTGTCTGTAACAAGAATACAAAGATTTCAGGACCAGGTGCTTGATCTTTTAAAGACT 1020
83P4B8v.6    CTTCTGTCTGTAACAAGAATACAAAGATTTCAGGACCAGGTGCTTGATCTTTTAAAGACT 1020
             ************************************************************

83P4B8v.3    TCGGTTGTAAAGAGCTTTAAGGATCTTCAACTCCTCCAAGGCTCAAAATTTCTTCAGAAT 1080
83P4B8v.4    TCGGTTGTAAAGAGCTTTAAGGATCTTCAACTCCTCCAAGGCTCAAAATTTCTTCAGAAT 1080
83P4B8v.2    TCGGTTGTAAAGAGCTTTAAGGATCTTCAACTCCTCCAAGGCTCAAAATTTCTTCAGAAT 1022
83P4B8v.1    TCGGTTGTAAAGAGCTTTAAGGATCTTCAACTCCTCCAAGGCTCAAAATTTCTTCAGAAT 1080
83P4B8v.5    TCGGTTGTAAAGAGCTTTAAGGATCTTCAACTCCTCCAAGGCTCAAAATTTCTTCAGAAT 1080
83P4B8v.6    TCGGTTGTAAAGAGCTTTAAGGATCTTCAACTCCTCCAAGGCTCAAAATTTCTTCAGAAT 1080
             ************************************************************

83P4B8v.3    CTAGTTCCTCATAGATCTTATGTTTCAACCATGATCTTGGAAGTAGTGAAGAATAGCGTT 1140
83P4B8v.4    CTAGTTCCTCATAGATCTTATGTTTCAACCATGATCTTGGAAGTAGTGAAGAATAGCGTT 1140
83P4B8v.2    CTAGTTCCTCATAGATCTTATGTTTCAACCATGATCTTGGAAGTAGTGAAGAATAGCGTT 1082
83P4B8v.1    CTAGTTCCTCATAGATCTTATGTTTCAACCATGATCTTGGAAGTAGTGAAGAATAGCGTT 1140
83P4B8v.5    CTAGTTCCTCATAGATCTTATGTTTCAACCATGATCTTGGAAGTAGTGAAGAATAGCGTT 1140
83P4B8v.6    CTAGTTCCTCATAGATCTTATGTTTCAACCATGATCTTGGAAGTAGTGAAGAATAGCGTT 1140
             ************************************************************

83P4B8v.3    CATAGCTGGGACCATGTTACTCAGGGCCTCGTAGAACTTGGTTTCATTTTGATGGATTCA 1200
83P4B8v.4    CATAGCTGGGACCATGTTACTCAGGGCCTCGTAGAACTTGGTTTCATTTTGATGGATTCA 1200
```

Figure 13b (continued)

```
83P4B8v.2    CATAGCTGGGACCATGTTACTCAGGGCCTCGTAGAACTTGGTTTCATTTTGATGGATTCA 1142
83P4B8v.1    CATAGCTGGGACCATGTTACTCAGGGCCTCGTAGAACTTGGTTTCATTTTGATGGATTCA 1200
83P4B8v.5    CATAGCTGGGACCATGTTACTCAGGGCCTCGTAGAACTTGGTTTCATTTTGATGGATTCA 1200
83P4B8v.6    CATAGCTGGGACCATGTTACTCAGGGCCTCGTAGAACTTGGTTTCATTTTGATGGATTCA 1200
             ************************************************************

83P4B8v.3    TATGGGCCAAAGAAGGTTCTTGATGGAAAAACTATTGAAACCAGCCCAAGTCTTTCTAGA 1260
83P4B8v.4    TATGGGCCAAAGAAGGTTCTTGATGGAAAAACTATTGAAACCAGCCCAAGTCTTTCTAGA 1260
83P4B8v.2    TATGGGCCAAAGAAGGTTCTTGATGGAAAAACTATTGAAACCAGCCCAAGTCTTTCTAGA 1202
83P4B8v.1    TATGGGCCAAAGAAGGTTCTTGATGGAAAAACTATTGAAACCAGCCCAAGTCTTTCTAGA 1260
83P4B8v.5    TATGGGCCAAAGAAGGTTCTTGATGGAAAAACTATTGAAACCAGCCCAAGTCTTTCTAGA 1260
83P4B8v.6    TATGGGCCAAAGAAGGTTCTTGATGGAAAAACTATTGAAACCAGCCCAAGTCTTTCTAGA 1260
             ************************************************************

83P4B8v.3    ATGCCAAACCAGCATGCATGTAAGCTCGGAGCTAATATCCTGTTGGAAACTTTTAAGATC 1320
83P4B8v.4    ATGCCAAACCAGCATGCATGTAAGCTCGGAGCTAATATCCTGTTGGAAACTTTTAAGATC 1320
83P4B8v.2    ATGCCAAACCAGCATGCATGTAAGCTCGGAGCTAATATCCTGTTGGAAACTTTTAAGATC 1262
83P4B8v.1    ATGCCAAACCAGCATGCATGTAAGCTCGGAGCTAATATCCTGTTGGAAACTTTTAAGATC 1320
83P4B8v.5    ATGCCAAACCAGCATGCATGTAAGCTCGGAGCTAATATCCTGTTGGAAACTTTTAAGATC 1320
83P4B8v.6    ATGCCAAACCAGCATGCATGTAAGCTCGGAGCTAATATCCTGTTGGAAACTTTTAAGATC 1320
             ************************************************************

83P4B8v.3    CATGAGATGATCAGACAAGAAATTTTGGAGCAGGTCCTCAACAGGGTTGTTACCAGAGCA 1380
83P4B8v.4    CATGAGATGATCAGACAAGAAATTTTGGAGCAGGTCCTCAACAGGGTTGTTACCAGAGCA 1380
83P4B8v.2    CATGAGATGATCAGACAAGAAATTTTGGAGCAGGTCCTCAACAGGGTTGTTACCAGAGCA 1322
83P4B8v.1    CATGAGATGATCAGACAAGAAATTTTGGAGCAGGTCCTCAACAGGGTTGTTACCAGAGCA 1380
83P4B8v.5    CATGAGATGATCAGACAAGAAATTTTGGAGCAGGTCCTCAACAGGGTTGTTACCAGAGCA 1380
83P4B8v.6    CATGAGATGATCAGACAAGAAATTTTGGAGCAGGTCCTCAACAGGGTTGTTACCAGAGCA 1380
             ************************************************************

83P4B8v.3    TCTTCTCCCATCAGTCATTTCTTAGACCTGCTTTCAAATATCGTCATGTATGCACCCTTA 1440
83P4B8v.4    TCTTCTCCCATCAGTCATTTCTTAGACCTGCTTTCAAATATCGTCATGTATGCACCCTTA 1440
83P4B8v.2    TCTTCTCCCATCAGTCATTTCTTAGACCTGCTTTCAAATATCGTCATGTATGCACCCTTA 1382
83P4B8v.1    TCTTCTCCCATCAGTCATTTCTTAGACCTGCTTTCAAATATCGTCATGTATGCACCCTTA 1440
83P4B8v.5    TCTTCTCCCATCAGTCATTTCTTAGACCTGCTTTCAAATATCGTCATGTATGCACCCTTA 1440
83P4B8v.6    TCTTCTCCCATCAGTCATTTCTTAGACCTGCTTTCAAATATCGTCATGTATGCACCCTTA 1440
             ************************************************************

83P4B8v.3    GTTCTTCAAAGTTGTTCTTCTAAAGTCACAGAAGCTTTTGACTATTTGTCCTTTCTGCCC 1500
```

Figure 13b (continued)

```
83P4B8v.4    GTTCTTCAAAGTTGTTCTTCTAAAGTCACAGAAGCTTTTGACTATTTGTCCTTTCTGCCC 1500
83P4B8v.2    GTTCTTCAAAGTTGTTCTTCTAAAGTCACAGAAGCTTTTGACTATTTGTCCTTTCTGCCC 1442
83P4B8v.1    GTTCTTCAAAGTTGTTCTTCTAAAGTCACAGAAGCTTTTGACTATTTGTCCTTTCTGCCC 1500
83P4B8v.5    GTTCTTCAAAGTTGTTCTTCTAAAGTCACAGAAGCTTTTGACTATTTGTCCTTTCTGCCC 1500
83P4B8v.6    GTTCTTCAAAGTTGTTCTTCTAAAGTCACAGAAGCTTTTGACTATTTGTCCTTTCTGCCC 1500
             ************************************************************

83P4B8v.3    CTTCAGACTGTACAAAGGCTGCTTAAGGCAGTGCAGCCCCTTCTCAAAGTCAGCATGTCA 1560
83P4B8v.4    CTTCAGACTGTACAAAGGCTGCTTAAGGCAGTGCAGCCCCTTCTCAAAGTCAGCATGTCA 1560
83P4B8v.2    CTTCAGACTGTACAAAGGCTGCTTAAGGCAGTGCAGCCCCTTCTCAAAGTCAGCATGTCA 1502
83P4B8v.1    CTTCAGACTGTACAAAGGCTGCTTAAGGCAGTGCAGCCCCTTCTCAAAGTCAGCATGTCA 1560
83P4B8v.5    CTTCAGACTGTACAAAGGCTGCTTAAGGCAGTGCAGCCCCTTCTCAAAGTCAGCATGTCA 1560
83P4B8v.6    CTTCAGACTGTACAAAGGCTGCTTAAGGCAGTGCAGCCCCTTCTCAAAGTCAGCATGTCA 1560
             ************************************************************

83P4B8v.3    ATGAGAGACTGCTTGATACTTGTCCTTCGGAAAGCTATGTTTGCCAACCAGCTTGATGCC 1620
83P4B8v.4    ATGAGAGACTGCTTGATACTTGTCCTTCGGAAAGCTATGTTTGCCAACCAGCTTGATGCC 1620
83P4B8v.2    ATGAGAGACTGCTTGATACTTGTCCTTCGGAAAGCTATGTTTGCCAACCAGCTTGATGCC 1562
83P4B8v.1    ATGAGAGACTGCTTGATACTTGTCCTTCGGAAAGCTATGTTTGCCAACCAGCTTGATGCC 1620
83P4B8v.5    ATGAGAGACTGCTTGATACTTGTCCTTCGGAAAGCTATGTTTGCCAACCAGCTTGATGCC 1620
83P4B8v.6    ATGAGAGACTGCTTGATACTTGTCCTTCGGAAAGCTATGTTTGCCAACCAGCTTGATGCC 1620
             ************************************************************

83P4B8v.3    CGAAAATCTGCAGTTGCTGGGTTTTTGCTGCTCCTGAAGAACTTTAAAGTTTTAGGCAGC 1680
83P4B8v.4    CGAAAATCTGCAGTTGCTGGGTTTTTGCTGCTCCTGAAGAACTTTAAAGTTTTAGGCAGC 1680
83P4B8v.2    CGAAAATCTGCAGTTGCTGGGTTTTTGCTGCTCCTGAAGAACTTTAAAGTTTTAGGCAGC 1622
83P4B8v.1    CGAAAATCTGCAGTTGCTGGGTTTTTGCTGCTCCTGAAGAACTTTAAAGTTTTAGGCAGC 1680
83P4B8v.5    CGAAAATCTGCAGTTGCTGGGTTTTTGCTGCTCCTGAAGAACTTTAAAGTTTTAGGCAGC 1680
83P4B8v.6    CGAAAATCTGCAGTTGCTGGGTTTTTGCTGCTCCTGAAGAACTTTAAAGTTTTAGGCAGC 1680
             ************************************************************

83P4B8v.3    CTGTCATCCTCTCAGTGCAGTCAGTCTCTCAGTGTCAGTCAGGTTCATGTGGATGTTCAC 1740
83P4B8v.4    CTGTCATCCTCTCAGTGCAGTCAGTCTCTCAGTGTCAGTCAGGTTCATGTGGATGTTCAC 1740
83P4B8v.2    CTGTCATCCTCTCAGTGCAGTCAGTCTCTCAGTGTCAGTCAGGTTCATGTGGATGTTCAC 1682
83P4B8v.1    CTGTCATCCTCTCAGTGCAGTCAGTCTCTCAGTGTCAGTCAGGTTCATGTGGATGTTCAC 1740
83P4B8v.5    CTGTCATCCTCTCAGTGCAGTCAGTCTCTCAGTGTCAGTCAGGTTCATGTGGATGTTCAC 1740
83P4B8v.6    CTGTCATCCTCTCAGTGCAGTCAGTCTCTCAGTGTCAGTCAGGTTCATGTGGATGTTCAC 1740
             ************************************************************
```

Figure 13b (continued)

```
83P4B8v.3   AGCCATTACAATTCTGTCGCCAATGAAACTTTTTGCCTTGAGATCATGGATAGTTTGAGG 1800
83P4B8v.4   AGCCATTACAATTCTGTCGCCAATGAAACTTTTTGCCTTGAGATCATGGATAGTTTGAGG 1800
83P4B8v.2   AGCCATTACAATTCTGTCGCCAATGAAACTTTTTGCCTTGAGATCATGGATAGTTTGAGG 1742
83P4B8v.1   AGCCATTACAATTCTGTCGCCAATGAAACTTTTTGCCTTGAGATCATGGATAGTTTGAGG 1800
83P4B8v.5   AGCCATTACAATTCTGTCGCCAATGAAACTTTTTGCCTTGAGATCATGGATAGTTTGAGG 1800
83P4B8v.6   AGCCATTACAATTCTGTCGCCAATGAAACTTTTTGCCTTGAGATCATGGATAGTTTGAGG 1800
            ************************************************************

83P4B8v.3   AGATGCTTAAGCCAGCAAGCTGATGTTCGACTCATGCTTTATGAGGGGTTTTATGATGTT 1860
83P4B8v.4   AGATGCTTAAGCCAGCAAGCTGATGTTCGACTCATGCTTTATGAGGGGTTTTATGATGTT 1860
83P4B8v.2   AGATGCTTAAGCCAGCAAGCTGATGTTCGACTCATGCTTTATGAGGGGTTTTATGATGTT 1802
83P4B8v.1   AGATGCTTAAGCCAGCAAGCTGATGTTCGACTCATGCTTTATGAGGGGTTTTATGATGTT 1860
83P4B8v.5   AGATGCTTAAGCCAGCAAGCTGATGTTCGACTCATGCTTTATGAGGGGTTTTATGATGTT 1860
83P4B8v.6   AGATGCTTAAGCCAGCAAGCTGATGTTCGACTCATGCTTTATGAGGGGTTTTATGATGTT 1860
            ************************************************************

83P4B8v.3   CTTCGAAGGAACTCTCAGCTGGCTAATTCAGTCATGCAAACTCTGCTCTCACAGTTAAAA 1920
83P4B8v.4   CTTCGAAGGAACTCTCAGCTGGCTAATTCAGTCATGCAAACTCTGCTCTCACAGTTAAAA 1920
83P4B8v.2   CTTCGAAGGAACTCTCAGCTGGCTAATTCAGTCATGCAAACTCTGCTCTCACAGTTAAAA 1862
83P4B8v.1   CTTCGAAGGAACTCTCAGCTGGCTAATTCAGTCATGCAAACTCTGCTCTCACAGTTAAAA 1920
83P4B8v.5   CTTCGAAGGAACTCTCAGCTGGCTAATTCAGTCATGCAAACTCTGCTCTCACAGTTAAAA 1920
83P4B8v.6   CTTCGAAGGAACTCTCAGCTGGCTAATTCAGTCATGCAAACTCTGCTCTCACAGTTAAAA 1920
            ************************************************************

83P4B8v.3       CAGTTCTATGAGCCAAAACCTGATCTGCTGCCTCCTCTGAAATTAGATGCTTGTATTCTG 1980
83P4B8v.4       CAGTTCTATGAGCCAAAACCTGATCTGCTGCCTCCTCTGAAATTAGATGCTTGTATTCTG 1980
83P4B8v.2       CAGTTCTATGAGCCAAAACCTGATCTGCTGCCTCCTCTGAAATTAGATGCTTGTATTCTG 1922
83P4B8v.1       CAGTTCTATGAGCCAAAACCTGATCTGCTGCCTCCTCTGAAATTAGATGCTTGTATTCTG 1980
83P4B8v.5       CAGTTCTATGAGCCAAAACCTGATCTGCTGCCTCCTCTGAAATTAGATGCTTGTATTCTG 1980
83P4B8v.6       CAGTTCTATGAGCCAAAACCTGATCTGCTGCCTCCTCTGAAATTAGATGCTTGTATTCTG 1980
                ************************************************************

83P4B8v.3       ACCCAAGGAGATAAGATCTCTCTACAAGAACCACTGGATTATCTGCTGTGTTGTATTCAG 2040
83P4B8v.4       ACCCAAGGAGATAAGATCTCTCTACAAGAACCACTGGATTATCTGCTGTGTTGTATTCAG 2040
83P4B8v.2       ACCCAAGGAGATAAGATCTCTCTACAAGAACCACTGGATTATCTGCTGTGTTGTATTCAG 1982
83P4B8v.1       ACCCAAGGAGATAAGATCTCTCTACAAGAACCACTGGATTATCTGCTGTGTTGTATTCAG 2040
83P4B8v.5       ACCCAAGGAGATAAGATCTCTCTACAAGAACCACTGGATTATCTGCTGTGTTGTATTCAG 2040
83P4B8v.6       ACCCAAGGAGATAAGATCTCTCTACAAGAACCACTGGATTATCTGCTGTGTTGTATTCAG 2040
                ************************************************************
```

Figure 13b (continued)

```
83P4B8v.3       CATTGTTTGGCCTGGTATAAGAATACAGTCATACCCTTACAGCAGGGAGAGGAGGAAGAG 2100
83P4B8v.4       CATTGTTTGGCCTGGTATAAGAATACAGTCATACCCTTACAGCAGGGAGAGGAGGAAGAG 2100
83P4B8v.2       CATTGTTTGGCCTGGTATAAGAATACAGTCATACCCTTACAGCAGGGAGAGGAGGAAGAG 2042
83P4B8v.1       CATTGTTTGGCCTGGTATAAGAATACAGTCATACCCTTACAGCAGGGAGAGGAGGAAGAG 2100
83P4B8v.5       CATTGTTTGGCCTGGTATAAGAATACAGTCATACCCTTACAGCAGGGAGAGGAGGAAGAG 2100
83P4B8v.6       CATTGTTTGGCCTGGTATAAGAATACAGTCATACCCTTACAGCAGGGAGAGGAGGAAGAG 2100
                ************************************************************

83P4B8v.3       GAGGAGGAAGAGGCATTCTACGAAGACCTAGATGATATATTGGAGTCCATTACTAATAGA 2160
83P4B8v.4       GAGGAGGAAGAGGCATTCTACGAAGACCTAGATGATATATTGGAGTCCATTACTAATAGA 2160
83P4B8v.2       GAGGAGGAAGAGGCATTCTACGAAGACCTAGATGATATATTGGAGTCCATTACTAATAGA 2102
83P4B8v.1       GAGGAGGAAGAGGCATTCTACGAAGACCTAGATGATATATTGGAGTCCATTACTAATAGA 2160
83P4B8v.5       GAGGAGGAAGAGGCATTCTACGAAGACCTAGATGATATATTGGAGTCCATTACTAATAGA 2160
83P4B8v.6       GAGGAGGAAGAGGCATTCTACGAAGACCTAGATGATATATTGGAGTCCATTACTAATAGA 2160
                ************************************************************

83P4B8v.3       ATGATTAAGAGTGAGCTGGAAGACTTTGAACTGGATAAATCAGCAGATTTTTCTCAGAGC 2220
83P4B8v.4       ATGATTAAGAGTGAGCTGGAAGACTTTGAACTGGATAAATCAGCAGATTTTTCTCAGAGC 2220
83P4B8v.2       ATGATTAAGAGTGAGCTGGAAGACTTTGAACTGGATAAATCAGCAGATTTTTCTCAGAGC 2162
83P4B8v.1       ATGATTAAGAGTGAGCTGGAAGACTTTGAACTGGATAAATCAGCAGATTTTTCTCAGAGC 2220
83P4B8v.5       ATGATTAAGAGTGAGCTGGAAGACTTTGAACTGGATAAATCAGCAGATTTTTCTCAGAGC 2220
83P4B8v.6       ATGATTAAGAGTGAGCTGGAAGACTTTGAACTGGATAAATCAGCAGATTTTTCTCAGAGC 2220
                ************************************************************

83P4B8v.3       ACCAGTATTGGCATAAAAAATAATATCTCTGCTTTTCTTGTGATGGGAGTTTGTGAGGTT 2280
83P4B8v.4       ACCAGTATTGGCATAAAAAATAATATCTCTGCTTTTCTTGTGATGGGAGTTTGTGAGGTT 2280
83P4B8v.2       ACCAGTATTGGCATAAAAAATAATATCTCTGCTTTTCTTGTGATGGGAGTTTGTGAGGTT 2222
83P4B8v.1       ACCAGTATTGGCATAAAAAATAATATCTCTGCTTTTCTTGTGATGGGAGTTTGTGAGGTT 2280
83P4B8v.5       ACCAGTATTGGCATAAAAAATAATATCTCTGCTTTTCTTGTGATGGGAGTTTGTGAGGTT 2280
83P4B8v.6       ACCAGTATTGGCATAAAAAATAATATCTCTGCTTTTCTTGTGATGGGAGTTTGTGAGGTT 2280
                ************************************************************

83P4B8v.3       TTAATAGAATACAATTTCTCCATAAGTAGTTTCAGTAAGAATAGGTTTGAGGACATTCTG 2340
83P4B8v.4       TTAATAGAATACAATTTCTCCATAAGTAGTTTCAGTAAGAATAGGTTTGAGGACATTCTG 2340
83P4B8v.2       TTAATAGAATACAATTTCTCCATAAGTAGTTTCAGTAAGAATAGGTTTGAGGACATTCTG 2282
83P4B8v.1       TTAATAGAATACAATTTCTCCATAAGTAGTTTCAGTAAGAATAGGTTTGAGGACATTCTG 2340
83P4B8v.5       TTAATAGAATACAATTTCTCCATAAGTAGTTTCAGTAAGAATAGGTTTGAGGACATTCTG 2340
83P4B8v.6       TTAATAGAATACAATTTCTCCATAAGTAGTTTCAGTAAGAATAGGTTTGAGGACATTCTG 2340
                ************************************************************
```

Figure 13b (continued)

```
83P4B8v.3       AGCTTATTTATGTGTTACAAAAAACTCTCTGACATTCTTAATGAAAAAGCGGGTAAAGCC 2400
83P4B8v.4       AGCTTATTTATGTGTTACAAAAAACTCTCTGACATTCTTAATGAAAAAGCGGGTAAAGCC 2400
83P4B8v.2       AGCTTATTTATGTGTTACAAAAAACTCTCTGACATTCTTAATGAAAAAGCGGGTAAAGCC 2342
83P4B8v.1       AGCTTATTTATGTGTTACAAAAAACTCTCTGACATTCTTAATGAAAAAGCGGGTAAAGCC 2400
83P4B8v.5       AGCTTATTTATGTGTTACAAAAAACTCTCTGACATTCTTAATGAAAAAGCGGGTAAAGCC 2400
83P4B8v.6       AGCTTATTTATGTGTTACAAAAAACTCTCTGACATTCTTAATGAAAAAGCGGGTAAAGCC 2400
                ************************************************************

83P4B8v.3       AAAACTAAAATGGCCAACAAGACAAGTGATAGTCTTTTGTCCATGAAATTTGTGTCCAGT 2460
83P4B8v.4       AAAACTAAAATGGCCAACAAGACAAGTGATAGTCTTTTGTCCATGAAATTTGTGTCCAGT 2460
83P4B8v.2       AAAACTAAAATGGCCAACAAGACAAGTGATAGTCTTTTGTCCATGAAATTTGTGTCCAGT 2402
83P4B8v.1       AAAACTAAAATGGCCAACAAGACAAGTGATAGTCTTTTGTCCATGAAATTTGTGTCCAGT 2460
83P4B8v.5       AAAACTAAAATGGCCAACAAGACAAGTGATAGTCTTTTGTCCATGAAATTTGTGTCCAGT 2460
83P4B8v.6       AAAACTAAAATGGCCAACAAGACAAGTGATAGTCTTTTGTCCATGAAATTTGTGTCCAGT 2460
                ************************************************************

83P4B8v.3       CTTCTCACTGCTCTTTTCAGG--------------------------------------- 2481
83P4B8v.4       CTTCTCACTGCTCTTTTCAG---------------------------------------- 2480
83P4B8v.2       CTTCTCACTGCTCTTTTCAGGGATAGTATCCAAAGCCACCAAGAAAGCCTTTCTGTTCTC 2462
83P4B8v.1       CTTCTCACTGCTCTTTTCAGGGATAGTATCCAAAGCCACCAAGAAAGCCTTTCTGTTCTC 2520
83P4B8v.5       CTTCTCACTGCTCTTTTCAGGGATAGTATCCAAAGCCACCAAGAAAGCCTTTCTGTTCTC 2520
83P4B8v.6       CTTCTCACTGCTCTTTTCAG---------------------------------------- 2480
                ********************

83P4B8v.3       ---TCCAGCAATGAGTTTATGCGCTATGCAGTGAATGTAGCTCTGCAGAAAGTACAGCAG 2539
83P4B8v.4       ------------------------------------------------------------
83P4B8v.2       AGGTCCAGCAATGAGTTTATGCGCTATGCAGTGAATGTAGCTCTGCAGAAAGTACAGCAG 2522
83P4B8v.1       AGGTCCAGCAATGAGTTTATGCGCTATGCAGTGAATGTAGCTCTGCAGAAAGTACAGCAG 2580
83P4B8v.5       AGGTCCAGCAATGAGTTTATGCGCTATGCAGTGAATGTAGCTCTGCAGAAAGTACAGCAG 2580
83P4B8v.6       ------------------------------------------------------------

83P4B8v.3       CTAAAGGAAACAGGGCATGTGAGTGGCCCTGATGGCCAAAACCCAGAAAAGATCTTTCAG 2598
83P4B8v.4       ------------------------------------------------------------
83P4B8v.2       CTAAAGGAAACAGGGCATGTGAGTGGCCCTGATGGCCAAAACCCAGAAAAGATCTTTCAG 2582
83P4B8v.1       CTAAAGGAAACAGGGCATGTGAGTGGCCCTGATGGCCAAAACCCAGAAAAGATCTTTCAG 2640
83P4B8v.5       CTAAAGGAAACAGGGCATGTGAGTGGCCCTGATGGCCAAAACCCAGAAAAGATCTTTCAG 2640
83P4B8v.6       ------------------------------------------------------------
```

Figure 13b (continued)

```
83P4B8v.3    AACCTCTGTGACATAACTCGAGTCTTGCTATGGAGATACACTTCAATTCCTACTTCAGTG 2658
83P4B8v.4    --------------------AGTCTTGCTATGGAGATACACTTCAATTCCTACTTCAGTG 2520
83P4B8v.2    AACCTCTGTGACATAACTCGAGTCTTGCTATGGAGATACACTTCAATTCCTACTTCAGTG 2642
83P4B8v.1    AACCTCTGTGACATAACTCGAGTCTTGCTATGGAGATACACTTCAATTCCTACTTCAGTG 2700
83P4B8v.5    AACCTCTGTGACATAACTCGAGTCTTGCTATGGAGATACACTTCAATTCCTACTTCAGTG 2700
83P4B8v.6    --------------------AGTCTTGCTATGGAGATACACTTCAATTCCTACTTCAGTG 2520
                                 ****************************************

83P4B8v.3    GAAGAGTCGGGAAAGAAAGAGAAAGGAAAGAGCATCTCACTGCTGTGCTTGGAGGGTTTA 2718
83P4B8v.4    GAAGAGTCGGGAAAGAAAGAGAAAGGAAAGAGCATCTCACTGCTGTGCTTGGAGGGTTTA 2580
83P4B8v.2    GAAGAGTCGGGAAAGAAAGAGAAAGGAAAGAGCATCTCACTGCTGTGCTTGGAGGGTTTA 2702
83P4B8v.1    GAAGAGTCGGGAAAGAAAGAGAAAGGAAAGAGCATCTCACTGCTGTGCTTGGAGGGTTTA 2760
83P4B8v.5    GAAGAGTCGGGAAAGAAAGAGAAAGGAAAGAGCATCTCACTGCTGTGCTTGGAGGGTTTA 2760
83P4B8v.6    GAAGAGTCGGGAAAGAAAGAGAAAGGAAAGAGCATCTCACTGCTGTGCTTGGAGGGTTTA 2580
             ************************************************************

83P4B8v.3    CAGAAAATATTCAGTGCTGTGCAACAGTTCTATCAGCCCAAGATTCAGCAGTTTCTCAGA 2778
83P4B8v.4    CAGAAAATATTCAGTGCTGTGCAACAGTTCTATCAGCCCAAGATTCAGCAGTTTCTCAGA 2640
83P4B8v.2    CAGAAAATATTCAGTGCTGTGCAACAGTTCTATCAGCCCAAGATTCAGCAGTTTCTCAGA 2762
83P4B8v.1    CAGAAAATATTCAGTGCTGTGCAACAGTTCTATCAGCCCAAGATTCAGCAGTTTCTCAGA 2820
83P4B8v.5    CAGAAAATATTCAGTGCTGTGCAACAGTTCTATCAGCCCAAGATTCAGCAGTTTCTCAGA 2820
83P4B8v.6    CAGAAAATATTCAGTGCTGTGCAACAGTTCTATCAGCCCAAGATTCAGCAGTTTCTCAGA 2640
             ************************************************************

83P4B8v.3    GCTCTGGATGTCACAGATAAGGAAGGAGAAGAGAGAGAAGATGCAGATGTCAGTGTCACT 2838
83P4B8v.4    GCTCTGGATGTCACAGATAAGGAAGGAGAAGAGAGAGAAGATGCAGATGTCAGTGTCACT 2700
83P4B8v.2    GCTCTGGATGTCACAGATAAGGAAGGAGAAGAGAGAGAAGATGCAGATGTCAGTGTCACT 2822
83P4B8v.1    GCTCTGGATGTCACAGATAAGGAAGGAGAAGAGAGAGAAGATGCAGATGTCAGTGTCACT 2880
83P4B8v.5    GCTCTGGATGTCACAGATAAGGAAGGAGAAGAGAGAGAAGATGCAGATGTCAGTGTCACT 2880
83P4B8v.6    GCTCTGGATGTCACAGATAAGGAAGGAGAAGAGAGAGAAGATGCAGATGTCAGTGTCACT 2700
             ************************************************************

83P4B8v.3    CAGAGAACAGCATTCCAGATCCGGCAATTTCAGAGGTCCTTGTTGAATTTACTTAGCAGT 2898
83P4B8v.4    CAGAGAACAGCATTCCAGATCCGGCAATTTCAGAGGTCCTTGTTGAATTTACTTAGCAGT 2760
83P4B8v.2    CAGAGAACAGCATTCCAGATCCGGCAATTTCAGAGGTCCTTGTTGAATTTACTTAGCAGT 2882
83P4B8v.1    CAGAGAACAGCATTCCAGATCCGGCAATTTCAGAGGTCCTTGTTGAATTTACTTAGCAGT 2940
83P4B8v.5    CAGAGAACAGCATTCCAGATCCGGCAATTTCAGAGGTCCTTGTTGAATTTACTTAGCAGT 2940
83P4B8v.6    CAGAGAACAGCATTCCAGATCCGGCAATTTCAGAGGTCCTTGTTGAATTTACTTAGCAGT 2760
             ************************************************************
```

Figure 13b (continued)

```
83P4B8v.3       CAAGAGGAAGATTTTAATAGCAAAGAAGCCCTCCTGCTAGTCACGGTTCTTACCAGTTTG 2958
83P4B8v.4       CAAGAGGAAGATTTTAATAGCAAAGAAGCCCTCCTGCTAGTCACGGTTCTTACCAGTTTG 2820
83P4B8v.2       CAAGAGGAAGATTTTAATAGCAAAGAAGCCCTCCTGCTAGTCACGGTTCTTACCAGTTTG 2942
83P4B8v.1       CAAGAGGAAGATTTTAATAGCAAAGAAGCCCTCCTGCTAGTCACGGTTCTTACCAGTTTG 3000
83P4B8v.5       CAAGAGGAAGATTTTAATAGCAAAGAAGCCCTCCTGCTAGTCACGGTTCTTACCAGTTTG 3000
83P4B8v.6       CAAGAGGAAGATTTTAATAGCAAAGAAGCCCTCCTGCTAGTCACGGTTCTTACCAGTTTG 2820
                ************************************************************

83P4B8v.3       TCCAAGTTACTGGAGCCCTCCTCTCCTCAGTTTGTGCAGATGTTATCCTGGACATCAAAG 3018
83P4B8v.4       TCCAAGTTACTGGAGCCCTCCTCTCCTCAGTTTGTGCAGATGTTATCCTGGACATCAAAG 2880
83P4B8v.2       TCCAAGTTACTGGAGCCCTCCTCTCCTCAGTTTGTGCAGATGTTATCCTGGACATCAAAG 3002
83P4B8v.1       TCCAAGTTACTGGAGCCCTCCTCTCCTCAGTTTGTGCAGATGTTATCCTGGACATCAAAG 3060
83P4B8v.5       TCCAAGTTACTGGAGCCCTCCTCTCCTCAGTTTGTGCAGATGTTATCCTGGACATCAAAG 3060
83P4B8v.6       TCCAAGTTACTGGAGCCCTCCTCTCCTCAGTTTGTGCAGATGTTATCCTGGACATCAAAG 2880
                ************************************************************

83P4B8v.3       ATTTGCAAGGAAAACAGCCGGGAGGATGCCTTGTTTTGCAAGAGCTTGATGAACTTGCTC 3078
83P4B8v.4       ATTTGCAAGGAAAACAGCCGGGAGGATGCCTTGTTTTGCAAGAGCTTGATGAACTTGCTC 2940
83P4B8v.2       ATTTGCAAGGAAAACAGCCGGGAGGATGCCTTGTTTTGCAAGAGCTTGATGAACTTGCTC 3062
83P4B8v.1       ATTTGCAAGGAAAACAGCCGGGAGGATGCCTTGTTTTGCAAGAGCTTGATGAACTTGCTC 3120
83P4B8v.5       ATTTGCAAGGAAAACAGCCGGGAGGATGCCTTGTTTTGCAAGAGCTTGATGAACTTGCTC 3120
83P4B8v.6       ATTTGCAAGGAAAACAGCCGGGAGGATGCCTTGTTTTGCAAGAGCTTGATGAACTTGCTC 2940
                ************************************************************

83P4B8v.3       TTCAGCCTGCATGTTTCGTATAAGAGTCCTGTCATTCTGCTGCGTGACTTGTCCCAGGAT 3138
83P4B8v.4       TTCAGCCTGCATGTTTCGTATAAGAGTCCTGTCATTCTGCTGCGTGACTTGTCCCAGGAT 3000
83P4B8v.2       TTCAGCCTGCATGTTTCGTATAAGAGTCCTGTCATTCTGCTGCGTGACTTGTCCCAGGAT 3122
83P4B8v.1       TTCAGCCTGCATGTTTCGTATAAGAGTCCTGTCATTCTGCTGCGTGACTTGTCCCAGGAT 3180
83P4B8v.5       TTCAGCCTGCATGTTTCGTATAAGAGTCCTGTCATTCTGCTGCGTGACTTGTCCCAGGAT 3180
83P4B8v.6       TTCAGCCTGCATGTTTCGTATAAGAGTCCTGTCATTCTGCTGCGTGACTTGTCCCAGGAT 3000
                ************************************************************

83P4B8v.3       ATCCACGGGCATCTGGGAGATATAGACCAGGATGTAGAGGTGGAGAAAACAAACCACTTT 3198
83P4B8v.4       ATCCACGGGCATCTGGGAGATATAGACCAGGATGTAGAGGTGGAGAAAACAAACCACTTT 3060
83P4B8v.2       ATCCACGGGCATCTGGGAGATATAGACCAGGATGTAGAGGTGGAGAAAACAAACCACTTT 3182
83P4B8v.1       ATCCACGGGCATCTGGGAGATATAGACCAGGATGTAGAGGTGGAGAAAACAAACCACTTT 3240
83P4B8v.5       ATCCACGGGCATCTGGGAGATATAGACCAGGATGTAGAGGTGGAGAAAACAAACCACTTT 3240
83P4B8v.6       ATCCACGGGCATCTGGGAGATATAGACCAGGATGTAGAGGTGGAGAAAACAAACCACTTT 3060
                ************************************************************
```

Figure 13b (continued)

```
83P4B8v.3       GCAATAGTGAATTTGAGAACGGCTGCCCCCACTGTCTGTTTACTTGTTCTGAGTCAGGCC 3258
83P4B8v.4       GCAATAGTGAATTTGAGAACGGCTGCCCCCACTGTCTGTTTACTTGTTCTGAGTCAGGCC 3120
83P4B8v.2       GCAATAGTGAATTTGAGAACGGCTGCCCCCACTGTCTGTTTACTTGTTCTGAGTCAGGCC 3242
83P4B8v.1       GCAATAGTGAATTTGAGAACGGCTGCCCCCACTGTCTGTTTACTTGTTCTGAGTCAGGCC 3300
83P4B8v.5       GCAATAGTGAATTTGAGAACGGCTGCCCCCACTGTCTGTTTACTTGTTCTGAGTCAGGCC 3300
83P4B8v.6       GCAATAGTGAATTTGAGAACGGCTGCCCCCACTGTCTGTTTACTTGTTCTGAGTCAGGCC 3120
                ************************************************************

83P4B8v.3       GAGAAGGTTCTAGAAGAAGTGGACTGGCTAATCACCAAGCTTAAGGGACAAGTGAGCCAA 3318
83P4B8v.4       GAGAAGGTTCTAGAAGAAGTGGACTGGCTAATCACCAAGCTTAAGGGACAAGTGAGCCAA 3180
83P4B8v.2       GAGAAGGTTCTAGAAGAAGTGGACTGGCTAATCACCAAGCTTAAGGGACAAGTGAGCCAA 3302
83P4B8v.1       GAGAAGGTTCTAGAAGAAGTGGACTGGCTAATCACCAAGCTTAAGGGACAAGTGAGCCAA 3360
83P4B8v.5       GAGAAGGTTCTAGAAGAAGTGGACTGGCTAATCACCAAGCTTAAGGGACAAGTGAGCCAA 3360
83P4B8v.6       GAGAAGGTTCTAGAAGAAGTGGACTGGCTAATCACCAAGCTTAAGGGACAAGTGAGCCAA 3180
                ************************************************************

83P4B8v.3       GAAACCTTATCAGAAGAGGCCTCTTCTCAGGCAACCCTACCAAATCAGCCTGTTGAGAAA 3378
83P4B8v.4       GAAACCTTATCAGAAGAGGCCTCTTCTCAGGCAACCCTACCAAATCAGCCTGTTGAGAAA 3240
83P4B8v.2       GAAACCTTATCAGAAGAGGCCTCTTCTCAGGCAACCCTACCAAATCAGCCTGTTGAGAAA 3362
83P4B8v.1       GAAACCTTATCAGAAGAGGCCTCTTCTCAGGCAACCCTACCAAATCAGCCTGTTGAGAAA 3420
83P4B8v.5       GAAACCTTATCAG----------------------------------------------- 3373
83P4B8v.6       GAAACCTTATCAG----------------------------------------------- 3193
                *************

83P4B8v.3       GCTATCATCATGCAACTGGGAACTCTGCTTACATTTTTCCACGAGCTGGTGCAGACAGCT 3438
83P4B8v.4       GCTATCATCATGCAACTGGGAACTCTGCTTACATTTTTCCACGAGCTGGTGCAGACAGCT 3300
83P4B8v.2       GCTATCATCATGCAACTGGGAACTCTGCTTACATTTTTCCACGAGCTGGTGCAGACAGCT 3422
83P4B8v.1       GCTATCATCATGCAACTGGGAACTCTGCTTACATTTTTCCACGAGCTGGTGCAGACAGCT 3480
83P4B8v.5       ------------------------------------------------------------
83P4B8v.6       ------------------------------------------------------------

83P4B8v.3       CTGCCATCAGGCAGCTGTGTGGACACCTTGTTAAAGGACTTGTGCAAAATGTACACCACA 3498
83P4B8v.4       CTGCCATCAGGCAGCTGTGTGGACACCTTGTTAAAGGACTTGTGCAAAATGTACACCACA 3360
83P4B8v.2       CTGCCATCAGGCAGCTGTGTGGACACCTTGTTAAAGGACTTGTGCAAAATGTACACCACA 3482
83P4B8v.1       CTGCCATCAGGCAGCTGTGTGGACACCTTGTTAAAGGACTTGTGCAAAATGTACACCACA 3540
83P4B8v.5       ------------------------------------------------------------
83P4B8v.6       ------------------------------------------------------------
```

Figure 13b (continued)

```
83P4B8v.3      CTTACAGCCCTTGTCAGATATTATCTCCAGGTGTGTCAGAGCTCCGGAGGAATCCCAAAA 3558
83P4B8v.4      CTTACAGCCCTTGTCAGATATTATCTCCAGGTGTGTCAGAGCTCCGGAGGAATCCCAAAA 3420
83P4B8v.2      CTTACAGCCCTTGTCAGATATTATCTCCAGGTGTGTCAGAGCTCCGGAGGAATCCCAAAA 3542
83P4B8v.1      CTTACAGCCCTTGTCAGATATTATCTCCAGGTGTGTCAGAGCTCCGGAGGAATCCCAAAA 3600
83P4B8v.5      ---------------------TATCTCCAGGTGTGTCAGAGCTCCGGAGGAATCCCAAAA 3412
83P4B8v.6      ---------------------TATCTCCAGGTGTGTCAGAGCTCCGGAGGAATCCCAAAA 3232
                                    ***************************************

83P4B8v.3      AATATGGAAAAGCTGGTGAAGCTGTCTGGTTCTCATCTGACCCCCCTGTGTTATTCTTTC 3618
83P4B8v.4      AATATGGAAAAGCTGGTGAAGCTGTCTGGTTCTCATCTGACCCCCCTGTGTTATTCTTTC 3480
83P4B8v.2      AATATGGAAAAGCTGGTGAAGCTGTCTGGTTCTCATCTGACCCCCCTGTGTTATTCTTTC 3602
83P4B8v.1      AATATGGAAAAGCTGGTGAAGCTGTCTGGTTCTCATCTGACCCCCCTGTGTTATTCTTTC 3660
83P4B8v.5      AATATGGAAAAGCTGGTGAAGCTGTCTGGTTCTCATCTGACCCCCCTGTGTTATTCTTTC 3472
83P4B8v.6      AATATGGAAAAGCTGGTGAAGCTGTCTGGTTCTCATCTGACCCCCCTGTGTTATTCTTTC 3292
               ************************************************************

83P4B8v.3      ATTTCTTACGTACAGAATAAGAGTAAGAGCCTGAACTATACGGGAGAGAAAAAGGAGAAA 3678
83P4B8v.4      ATTTCTTACGTACAGAATAAGAGTAAGAGCCTGAACTATACGGGAGAGAAAAAGGAGAAA 3540
83P4B8v.2      ATTTCTTACGTACAGAATAAGAGTAAGAGCCTGAACTATACGGGAGAGAAAAAGGAGAAA 3662
83P4B8v.1      ATTTCTTACGTACAGAATAAGAGTAAGAGCCTGAACTATACGGGAGAGAAAAAGGAGAAA 3720
83P4B8v.5      ATTTCTTACGTACAGAATAAGAGTAAGAGCCTGAACTATACGGGAGAGAAAAAGGAGAAA 3532
83P4B8v.6      ATTTCTTACGTACAGAATAAGAGTAAGAGCCTGAACTATACGGGAGAGAAAAAGGAGAAA 3352
               ************************************************************

83P4B8v.3      CCTGCTGCCGTTGCCACAGCCATGGCCAGAGTTCTTCGGGAAACCAAGCCAATCCCTAAC 3738
83P4B8v.4      CCTGCTGCCGTTGCCACAGCCATGGCCAGAGTTCTTCGGGAAACCAAGCCAATCCCTAAC 3600
83P4B8v.2      CCTGCTGCCGTTGCCACAGCCATGGCCAGAGTTCTTCGGGAAACCAAGCCAATCCCTAAC 3722
83P4B8v.1      CCTGCTGCCGTTGCCACAGCCATGGCCAGAGTTCTTCGGGAAACCAAGCCAATCCCTAAC 3780
83P4B8v.5      CCTGCTGCCGTTGCCACAGCCATGGCCAGAGTTCTTCGGGAAACCAAGCCAATCCCTAAC 3592
83P4B8v.6      CCTGCTGCCGTTGCCACAGCCATGGCCAGAGTTCTTCGGGAAACCAAGCCAATCCCTAAC 3412
               ************************************************************

83P4B8v.3      CTCATCTTTGCCATAGAACAGTATGAAAAATTTCTCATCCACCTTTCTAAGAAGTCCAAG 3798
83P4B8v.4      CTCATCTTTGCCATAGAACAGTATGAAAAATTTCTCATCCACCTTTCTAAGAAGTCCAAG 3660
83P4B8v.2      CTCATCTTTGCCATAGAACAGTATGAAAAATTTCTCATCCACCTTTCTAAGAAGTCCAAG 3782
83P4B8v.1      CTCATCTTTGCCATAGAACAGTATGAAAAATTTCTCATCCACCTTTCTAAGAAGTCCAAG 3840
83P4B8v.5      CTCATCTTTGCCATAGAACAGTATGAAAAATTTCTCATCCACCTTTCTAAGAAGTCCAAG 3652
83P4B8v.6      CTCATCTTTGCCATAGAACAGTATGAAAAATTTCTCATCCACCTTTCTAAGAAGTCCAAG 3472
               ************************************************************
```

Figure 13b (continued)

```
83P4B8v.3       GTGAACCTGATGCAGCACATGAAGCTCAGCACCTCACGAGACTTCAAGATCAAAGGAAAC 3858
83P4B8v.4       GTGAACCTGATGCAGCACATGAAGCTCAGCACCTCACGAGACTTCAAGATCAAAGGAAAC 3720
83P4B8v.2       GTGAACCTGATGCAGCACATGAAGCTCAGCACCTCACGAGACTTCAAGATCAAAGGAAAC 3842
83P4B8v.1       GTGAACCTGATGCAGCACATGAAGCTCAGCACCTCACGAGACTTCAAGATCAAAGGAAAC 3900
83P4B8v.5       GTGAACCTGATGCAGCACATGAAGCTCAGCACCTCACGAGACTTCAAGATCAAAGGAAAC 3712
83P4B8v.6       GTGAACCTGATGCAGCACATGAAGCTCAGCACCTCACGAGACTTCAAGATCAAAGGAAAC 3532
                ************************************************************

83P4B8v.3       ATCCTAGACATGGTTCTTCGAGAGGATGGCGAAGATGAAAATGAAGAGGGCACTGCATCA 3918
83P4B8v.4       ATCCTAGACATGGTTCTTCGAGAGGATGGCGAAGATGAAAATGAAGAGGGCACTGCATCA 3780
83P4B8v.2       ATCCTAGACATGGTTCTTCGAGAGGATGGCGAAGATGAAAATGAAGAGGGCACTGCATCA 3902
83P4B8v.1       ATCCTAGACATGGTTCTTCGAGAGGATGGCGAAGATGAAAATGAAGAGGGCACTGCATCA 3960
83P4B8v.5       ATCCTAGACATGGTTCTTCGAGAGGATGGCGAAGATGAAAATGAAGAGGGCACTGCATCA 3772
83P4B8v.6       ATCCTAGACATGGTTCTTCGAGAGGATGGCGAAGATGAAAATGAAGAGGGCACTGCATCA 3592
                ************************************************************

83P4B8v.3       GAGCATGGGGGACAGAACAAAGAACCAGCCAAGAAGAAAAGGAAAAAATAAATGAAATGC 3978
83P4B8v.4       GAGCATGGGGGACAGAACAAAGAACCAGCCAAGAAGAAAAGGAAAAAATAAATGAAATGC 3840
83P4B8v.2       GAGCATGGGGGACAGAACAAAGAACCAGCCAAGAAGAAAAGGAAAAAATAAATGAAATGC 3962
83P4B8v.1       GAGCATGGGGGACAGAACAAAGAACCAGCCAAGAAGAAAAGGAAAAAATAAATGAAATGC 4020
83P4B8v.5       GAGCATGGGGGACAGAACAAAGAACCAGCCAAGAAGAAAAGGAAAAAATAAATGAAATGC 3832
83P4B8v.6       GAGCATGGGGGACAGAACAAAGAACCAGCCAAGAAGAAAAGGAAAAAATAAATGAAATGC 3652
                ************************************************************

83P4B8v.3       CTGAGTTAATGTG 3991
83P4B8v.4       CTGAGTTAATGTG 3853
83P4B8v.2       CTGAGTTAATGTG 3975
83P4B8v.1       CTGAGTTAATGTG 4033
83P4B8v.5       CTGAGTTAATGTG 3845
83P4B8v.6       CTGAGTTAATGTG 3665
                *************
```

Figure 14b Alignment of protein sequences of 83P4B8 transcript variants (SEQ ID NOs: 24, 120, 121, 122, 123, 124).

```
83P4B8v.1       MDQKILSLAAEKTADKLQEFLQTLREGDLTNLLQNQAVKGKVAGALLRAIFKGSPCSEEA 60
83P4B8v.2       ------------------------------------------------------------
83P4B8v.3_      MDQKILSLAAEKTADKLQEFLQTLREGDLTNLLQNQAVKGKVAGALLRAIFKGSPCSEEA 60
83P4B8v.4_      MDQKILSLAAEKTADKLQEFLQTLREGDLTNLLQNQAVKGKVAGALLRAIFKGSPCSEEA 60
83P4B8v.5_      MDQKILSLAAEKTADKLQEFLQTLREGDLTNLLQNQAVKGKVAGALLRAIFKGSPCSEEA 60
83P4B8v.6_      MDQKILSLAAEKTADKLQEFLQTLREGDLTNLLQNQAVKGKVAGALLRAIFKGSPCSEEA 60

83P4B8v.1       GTLRRRKIYTCCIQLVESGDLQKEIVSEIIGLLMLEAHHFPGPLLVELANEFISAVREGS 120
83P4B8v.2       ------------------------------------------------------------
83P4B8v.3_      GTLRRRKIYTCCIQLVESGDLQKEIVSEIIGLLMLEAHHFPGPLLVELANEFISAVREGS 120
83P4B8v.4_      GTLRRRKIYTCCIQLVESGDLQKEIVSEIIGLLMLEAHHFPGPLLVELANEFISAVREGS 120
83P4B8v.5_      GTLRRRKIYTCCIQLVESGDLQKEIVSEIIGLLMLEAHHFPGPLLVELANEFISAVREGS 120
83P4B8v.6_      GTLRRRKIYTCCIQLVESGDLQKEIVSEIIGLLMLEAHHFPGPLLVELANEFISAVREGS 120

83P4B8v.1       LVNGKSLELLPIILTALATKKENLAYGKGVLSGEECKKQLINTLCSGRWDQQYVIQHTSM 180
83P4B8v.2       -----------------------------------------------------------M 1
83P4B8v.3_      LVNGKSLELLPIILTALATKKENLAYGKGVLSGEECKKQLINTLCSGRWDQQYVIQHTSM 180
83P4B8v.4_      LVNGKSLELLPIILTALATKKENLAYGKGVLSGEECKKQLINTLCSGRWDQQYVIQHTSM 180
83P4B8v.5_      LVNGKSLELLPIILTALATKKENLAYGKGVLSGEECKKQLINTLCSGRWDQQYVIQHTSM 180
83P4B8v.6_      LVNGKSLELLPIILTALATKKENLAYGKGVLSGEECKKQLINTLCSGRWDQQYVIQHTSM 180
                                                                           *

83P4B8v.1       FKDVPLTAEEVEFVVEKALSMFSKMNLQEIPPLVYQLLVLSSKGSRKSVLEGIIAFFSAL 240
83P4B8v.2       FKDVPLTAEEVEFVVEKALSMFSKMNLQEIPPLVYQLLVLSSKGSRKSVLEGIIAFFSAL 61
83P4B8v.3_      FKDVPLTAEEVEFVVEKALSMFSKMNLQEIPPLVYQLLVLSSKGSRKSVLEGIIAFFSAL 240
83P4B8v.4_      FKDVPLTAEEVEFVVEKALSMFSKMNLQEIPPLVYQLLVLSSKGSRKSVLEGIIAFFSAL 240
83P4B8v.5_      FKDVPLTAEEVEFVVEKALSMFSKMNLQEIPPLVYQLLVLSSKGSRKSVLEGIIAFFSAL 240
83P4B8v.6_      FKDVPLTAEEVEFVVEKALSMFSKMNLQEIPPLVYQLLVLSSKGSRKSVLEGIIAFFSAL 240
                ************************************************************

83P4B8v.1       DKQHNEEQSGDELLDVVTVPSGELRHVEGTIILHIVFAIKLDYELGRELVKHLKVGQQGD 300
83P4B8v.2       DKQHNEEQSGDELLDVVTVPSGELRHVEGTIILHIVFAIKLDYELGRELVKHLKVGQQGD 121
83P4B8v.3_      DKQHNEEQSGDELLDVVTVPSGELRHVEGTIILHIVFAIKLDYELGRELVKHLKVGQQGD 300
83P4B8v.4_      DKQHNEEQSGDELLDVVTVPSGELRHVEGTIILHIVFAIKLDYELGRELVKHLKVGQQGD 300
83P4B8v.5_      DKQHNEEQSGDELLDVVTVPSGELRHVEGTIILHIVFAIKLDYELGRELVKHLKVGQQGD 300
```

Figure 14b (continued)

```
83P4B8v.6_      DKQHNEEQSGDELLDVVTVPSGELRHVEGTIILHIVFAIKLDYELGRELVKHLKVGQQGD 300
                ************************************************************

83P4B8v.1       SNNNLSPFSIALLLSVTRIQRFQDQVLDLLKTSVVKSFKDLQLLQGSKFLQNLVPHRSYV 360
83P4B8v.2       SNNNLSPFSIALLLSVTRIQRFQDQVLDLLKTSVVKSFKDLQLLQGSKFLQNLVPHRSYV 181
83P4B8v.3_      SNNNLSPFSIALLLSVTRIQRFQDQVLDLLKTSVVKSFKDLQLLQGSKFLQNLVPHRSYV 360
83P4B8v.4_      SNNNLSPFSIALLLSVTRIQRFQDQVLDLLKTSVVKSFKDLQLLQGSKFLQNLVPHRSYV 360
83P4B8v.5_      SNNNLSPFSIALLLSVTRIQRFQDQVLDLLKTSVVKSFKDLQLLQGSKFLQNLVPHRSYV 360
83P4B8v.6_      SNNNLSPFSIALLLSVTRIQRFQDQVLDLLKTSVVKSFKDLQLLQGSKFLQNLVPHRSYV 360
                ************************************************************

83P4B8v.1       STMILEVVKNSVHSWDHVTQGLVELGFILMDSYGPKKVLDGKTIETSPSLSRMPNQHACK 420
83P4B8v.2       STMILEVVKNSVHSWDHVTQGLVELGFILMDSYGPKKVLDGKTIETSPSLSRMPNQHACK 241
83P4B8v.3_      STMILEVVKNSVHSWDHVTQGLVELGFILMDSYGPKKVLDGKTIETSPSLSRMPNQHACK 420
83P4B8v.4_      STMILEVVKNSVHSWDHVTQGLVELGFILMDSYGPKKVLDGKTIETSPSLSRMPNQHACK 420
83P4B8v.5_      STMILEVVKNSVHSWDHVTQGLVELGFILMDSYGPKKVLDGKTIETSPSLSRMPNQHACK 420
83P4B8v.6_      STMILEVVKNSVHSWDHVTQGLVELGFILMDSYGPKKVLDGKTIETSPSLSRMPNQHACK 420
                ************************************************************

83P4B8v.1       LGANILLETFKIHEMIRQEILEQVLNRVVTRASSPISHFLDLLSNIVMYAPLVLQSCSSK 480
83P4B8v.2       LGANILLETFKIHEMIRQEILEQVLNRVVTRASSPISHFLDLLSNIVMYAPLVLQSCSSK 301
83P4B8v.3_      LGANILLETFKIHEMIRQEILEQVLNRVVTRASSPISHFLDLLSNIVMYAPLVLQSCSSK 480
83P4B8v.4_      LGANILLETFKIHEMIRQEILEQVLNRVVTRASSPISHFLDLLSNIVMYAPLVLQSCSSK 480
83P4B8v.5_      LGANILLETFKIHEMIRQEILEQVLNRVVTRASSPISHFLDLLSNIVMYAPLVLQSCSSK 480
83P4B8v.6_      LGANILLETFKIHEMIRQEILEQVLNRVVTRASSPISHFLDLLSNIVMYAPLVLQSCSSK 480
                ************************************************************

83P4B8v.1       VTEAFDYLSFLPLQTVQRLLKAVQPLLKVSMSMRDCLILVLRKAMFANQLDARKSAVAGF 540
83P4B8v.2       VTEAFDYLSFLPLQTVQRLLKAVQPLLKVSMSMRDCLILVLRKAMFANQLDARKSAVAGF 361
83P4B8v.3_      VTEAFDYLSFLPLQTVQRLLKAVQPLLKVSMSMRDCLILVLRKAMFANQLDARKSAVAGF 540
83P4B8v.4_      VTEAFDYLSFLPLQTVQRLLKAVQPLLKVSMSMRDCLILVLRKAMFANQLDARKSAVAGF 540
83P4B8v.5_      VTEAFDYLSFLPLQTVQRLLKAVQPLLKVSMSMRDCLILVLRKAMFANQLDARKSAVAGF 540
83P4B8v.6_      VTEAFDYLSFLPLQTVQRLLKAVQPLLKVSMSMRDCLILVLRKAMFANQLDARKSAVAGF 540
                ************************************************************

83P4B8v.1       LLLLKNFKVLGSLSSSQCSQSLSVSQVHVDVHSHYNSVANETFCLEIMDSLRRCLSQQAD 600
83P4B8v.2       LLLLKNFKVLGSLSSSQCSQSLSVSQVHVDVHSHYNSVANETFCLEIMDSLRRCLSQQAD 421
83P4B8v.3_      LLLLKNFKVLGSLSSSQCSQSLSVSQVHVDVHSHYNSVANETFCLEIMDSLRRCLSQQAD 600
83P4B8v.4_      LLLLKNFKVLGSLSSSQCSQSLSVSQVHVDVHSHYNSVANETFCLEIMDSLRRCLSQQAD 600
```

Figure 14b (continued)

```
83P4B8v.5_    LLLLKNFKVLGSLSSSQCSQSLSVSQVHVDVHSHYNSVANETFCLEIMDSLRRCLSQQAD 600
83P4B8v.6_    LLLLKNFKVLGSLSSSQCSQSLSVSQVHVDVHSHYNSVANETFCLEIMDSLRRCLSQQAD 600
              ************************************************************

83P4B8v.1     VRLMLYEGFYDVLRRNSQLANSVMQTLLSQLKQFYEPKPDLLPPLKLDACILTQGDKISL 660
83P4B8v.2     VRLMLYEGFYDVLRRNSQLANSVMQTLLSQLKQFYEPKPDLLPPLKLDACILTQGDKISL 481
83P4B8v.3_    VRLMLYEGFYDVLRRNSQLANSVMQTLLSQLKQFYEPKPDLLPPLKLDACILTQGDKISL 660
83P4B8v.4_    VRLMLYEGFYDVLRRNSQLANSVMQTLLSQLKQFYEPKPDLLPPLKLDACILTQGDKISL 660
83P4B8v.5_    VRLMLYEGFYDVLRRNSQLANSVMQTLLSQLKQFYEPKPDLLPPLKLDACILTQGDKISL 660
83P4B8v.6_    VRLMLYEGFYDVLRRNSQLANSVMQTLLSQLKQFYEPKPDLLPPLKLDACILTQGDKISL 660
              ************************************************************

83P4B8v.1     QEPLDYLLCCIQHCLAWYKNTVIPLQQGEEEEEEEEAFYEDLDDILESITNRMIKSELED 720
83P4B8v.2     QEPLDYLLCCIQHCLAWYKNTVIPLQQGEEEEEEEEAFYEDLDDILESITNRMIKSELED 541
83P4B8v.3_    QEPLDYLLCCIQHCLAWYKNTVIPLQQGEEEEEEEEAFYEDLDDILESITNRMIKSELED 720
83P4B8v.4_    QEPLDYLLCCIQHCLAWYKNTVIPLQQGEEEEEEEEAFYEDLDDILESITNRMIKSELED 720
83P4B8v.5_    QEPLDYLLCCIQHCLAWYKNTVIPLQQGEEEEEEEEAFYEDLDDILESITNRMIKSELED 720
83P4B8v.6_    QEPLDYLLCCIQHCLAWYKNTVIPLQQGEEEEEEEEAFYEDLDDILESITNRMIKSELED 720
              ************************************************************

83P4B8v.1     FELDKSADFSQSTSIGIKNNISAFLVMGVCEVLIEYNFSISSFSKNRFEDILSLFMCYKK 780
83P4B8v.2     FELDKSADFSQSTSIGIKNNISAFLVMGVCEVLIEYNFSISSFSKNRFEDILSLFMCYKK 601
83P4B8v.3_    FELDKSADFSQSTSIGIKNNISAFLVMGVCEVLIEYNFSISSFSKNRFEDILSLFMCYKK 780
83P4B8v.4_    FELDKSADFSQSTSIGIKNNISAFLVMGVCEVLIEYNFSISSFSKNRFEDILSLFMCYKK 780
83P4B8v.5_    FELDKSADFSQSTSIGIKNNISAFLVMGVCEVLIEYNFSISSFSKNRFEDILSLFMCYKK 780
83P4B8v.6_    FELDKSADFSQSTSIGIKNNISAFLVMGVCEVLIEYNFSISSFSKNRFEDILSLFMCYKK 780
              ************************************************************

83P4B8v.1     LSDILNEKAGKAKTKMANKTSDSLLSMKFVSSLLTALFRDSIQSHQESLSVLRSSNEFMR 840
83P4B8v.2     LSDILNEKAGKAKTKMANKTSDSLLSMKFVSSLLTALFRDSIQSHQESLSVLRSSNEFMR 661
83P4B8v.3_    LSDILNEKAGKAKTKMANKTSDSLLSMKFVSSLLTALFR--------------SSNEFMR 826
83P4B8v.4_    LSDILNEKAGKAKTKMANKTSDSLLSMKFVSSLLTALFR--------------------- 819
83P4B8v.5_    LSDILNEKAGKAKTKMANKTSDSLLSMKFVSSLLTALFRDSIQSHQESLSVLRSSNEFMR 840
83P4B8v.6_    LSDILNEKAGKAKTKMANKTSDSLLSMKFVSSLLTALFR--------------------- 819
              ***************************************

83P4B8v.1     YAVNVALQKVQQLKETGHVSGPDGQNPEKIFQNLCDITRVLLWRYTSIPTSVEESGKKEK 900
83P4B8v.2     YAVNVALQKVQQLKETGHVSGPDGQNPEKIFQNLCDITRVLLWRYTSIPTSVEESGKKEK 721
83P4B8v.3_    YAVNVALQKVQQLKETGHVSGPDGQNPEKIFQNLCDITRVLLWRYTSIPTSVEESGKKEK 886
```

Figure 14b (continued)

```
83P4B8v.4_    ---------------------------------------VLLWRYTSIPTSVEESGKKEK 840
83P4B8v.5_    YAVNVALQKVQQLKETGHVSGPDGQNPEKIFQNLCDITRVLLWRYTSIPTSVEESGKKEK 900
83P4B8v.6_    ---------------------------------------VLLWRYTSIPTSVEESGKKEK 840
                                                     *********************

83P4B8v.1     GKSISLLCLEGLQKIFSAVQQFYQPKIQQFLRALDVTDKEGEEREDADVSVTQRTAFQIR 960
83P4B8v.2     GKSISLLCLEGLQKIFSAVQQFYQPKIQQFLRALDVTDKEGEEREDADVSVTQRTAFQIR 781
83P4B8v.3_    GKSISLLCLEGLQKIFSAVQQFYQPKIQQFLRALDVTDKEGEEREDADVSVTQRTAFQIR 946
83P4B8v.4_    GKSISLLCLEGLQKIFSAVQQFYQPKIQQFLRALDVTDKEGEEREDADVSVTQRTAFQIR 900
83P4B8v.5_    GKSISLLCLEGLQKIFSAVQQFYQPKIQQFLRALDVTDKEGEEREDADVSVTQRTAFQIR 960
83P4B8v.6_    GKSISLLCLEGLQKIFSAVQQFYQPKIQQFLRALDVTDKEGEEREDADVSVTQRTAFQIR 900
              ************************************************************

83P4B8v.1     QFQRSLLNLLSSQEEDFNSKEALLLVTVLTSLSKLLEPSSPQFVQMLSWTSKICKENSRE 1020
83P4B8v.2     QFQRSLLNLLSSQEEDFNSKEALLLVTVLTSLSKLLEPSSPQFVQMLSWTSKICKENSRE 841
83P4B8v.3_    QFQRSLLNLLSSQEEDFNSKEALLLVTVLTSLSKLLEPSSPQFVQMLSWTSKICKENSRE 1006
83P4B8v.4_    QFQRSLLNLLSSQEEDFNSKEALLLVTVLTSLSKLLEPSSPQFVQMLSWTSKICKENSRE 960
83P4B8v.5_    QFQRSLLNLLSSQEEDFNSKEALLLVTVLTSLSKLLEPSSPQFVQMLSWTSKICKENSRE 1020
83P4B8v.6_    QFQRSLLNLLSSQEEDFNSKEALLLVTVLTSLSKLLEPSSPQFVQMLSWTSKICKENSRE 960
              ************************************************************

83P4B8v.1     DALFCKSLMNLLFSLHVSYKSPVILLRDLSQDIHGHLGDIDQDVEVEKTNHFAIVNLRTA 1080
83P4B8v.2     DALFCKSLMNLLFSLHVSYKSPVILLRDLSQDIHGHLGDIDQDVEVEKTNHFAIVNLRTA 901
83P4B8v.3_    DALFCKSLMNLLFSLHVSYKSPVILLRDLSQDIHGHLGDIDQDVEVEKTNHFAIVNLRTA 1066
83P4B8v.4_    DALFCKSLMNLLFSLHVSYKSPVILLRDLSQDIHGHLGDIDQDVEVEKTNHFAIVNLRTA 1020
83P4B8v.5_    DALFCKSLMNLLFSLHVSYKSPVILLRDLSQDIHGHLGDIDQDVEVEKTNHFAIVNLRTA 1080
83P4B8v.6_    DALFCKSLMNLLFSLHVSYKSPVILLRDLSQDIHGHLGDIDQDVEVEKTNHFAIVNLRTA 1020
              ************************************************************

83P4B8v.1     AFTVCLLVLSQAEKVLEEVDWLITKLKGQVSQETLSEEASSQATLPNQPVEKAIIMQLGT 1140
83P4B8v.2     AFTVCLLVLSQAEKVLEEVDWLITKLKGQVSQETLSEEASSQATLPNQPVEKAIIMQLGT 961
83P4B8v.3_    AFTVCLLVLSQAEKVLEEVDWLITKLKGQVSQETLSEEASSQATLPNQPVEKAIIMQLGT 1126
83P4B8v.4_    AFTVCLLVLSQAEKVLEEVDWLITKLKGQVSQETLSEEASSQATLPNQPVEKAIIMQLGT 1080
83P4B8v.5_    AFTVCLLVLSQAEKVLEEVDWLITKLKGQVSQETLSVSPG-------------------- 1120
83P4B8v.6_    AFTVCLLVLSQAEKVLEEVDWLITKLKGQVSQETLSVSPG-------------------- 1060
              ************************************ ...

83P4B8v.1     LLTFFHELVQTALPSGSCVDTLLKDLCKMYTTLTALVRYYLQVCQSSGGIPKNMEKLVKL 1200
83P4B8v.2     LLTFFHELVQTALPSGSCVDTLLKDLCKMYTTLTALVRYYLQVCQSSGGIPKNMEKLVKL 1021
```

Figure 14b (continued)

```
83P4B8v.3_      LLTFFHELVQTALPSGSCVDTLLKDLCKMYTTLTALVRYYLQVCQSSGGIPKNMEKLVKL 1186
83P4B8v.4_      LLTFFHELVQTALPSGSCVDTLLKDLCKMYTTLTALVRYYLQVCQSSGGIPKNMEKLVKL 1140
83P4B8v.5_      ------------------------------------------------------------
83P4B8v.6_      ------------------------------------------------------------

83P4B8v.1       SGSHLTPLCYSFISYVQNKSKSLNYTGEKKEKPAAVATAMARVLRETKPIPNLIFAIEQY 1260
83P4B8v.2       SGSHLTPLCYSFISYVQNKSKSLNYTGEKKEKPAAVATAMARVLRETKPIPNLIFAIEQY 1081
83P4B8v.3_      SGSHLTPLCYSFISYVQNKSKSLNYTGEKKEKPAAVATAMARVLRETKPIPNLIFAIEQY 1246
83P4B8v.4_      SGSHLTPLCYSFISYVQNKSKSLNYTGEKKEKPAAVATAMARVLRETKPIPNLIFAIEQY 1200
83P4B8v.5_      -------------------------VSELRRNPKKYGKAGEAVWFSSDP-PVLFFHFLRT 1154
83P4B8v.6_      -------------------------VSELRRNPKKYGKAGEAVWFSSDP-PVLFFHFLRT 1094
                                         ..* :.:*   ..*   *  .:.* * *:* : :

83P4B8v.1       EKFLIHLSKKSKVNLMQHMKLSTSRDFKIKGNILDMVLREDGEDENEEGTASEHGGQNKE 1320
83P4B8v.2       EKFLIHLSKKSKVNLMQHMKLSTSRDFKIKGNILDMVLREDGEDENEEGTASEHGGQNKE 1141
83P4B8v.3_      EKFLIHLSKKSKVNLMQHMKLSTSRDFKIKGNILDMVLREDGEDENEEGTASEHGGQNKE 1306
83P4B8v.4_      EKFLIHLSKKSKVNLMQHMKLSTSRDFKIKGNILDMVLREDGEDENEEGTASEHGGQNKE 1260
83P4B8v.5_      E----------------------------------------------------------- 1155
83P4B8v.6_      E----------------------------------------------------------- 1095
                *

83P4B8v.1       PAKKKRKK 1328
83P4B8v.2       PAKKKRKK 1149
83P4B8v.3_      PAKKKRKK 1314
83P4B8v.4_      PAKKKRKK 1268
83P4B8v.5_      --------
83P4B8v.6_      --------
```

Figure 11c Nucleotide sequences of transcript variants of 109P1D4
>109P1D4 v.2 (SEQ ID NO:125).

```
cccctttctc cccctcggtt aagtccctcc ccctcgccat tcaaaagggc tggctcggca      60
ctggctcctt gcagtcggcg aactgtcggg gcgggaggag ccgtgagcag tagctgcact     120
cagctgcccg cgcggcaaag aggaaggcaa gccaaacaga gtgcgcagag tggcagtgcc     180
agcggcgaca caggcagcac aggcagcccg ggctgcctga atagcctcag aaacaacctc     240
agcgactccg gctgctctgc ggactgcgag ctgtggcggt agagcccgct acagcagtcg     300
cagtctccgt ggagcgggcg gaagcctttt ttctcccttt cgtttacctc ttcattctac     360
tctaaaggca tcgttattag gaaaatcctg ttgcgaataa gaaggattcc acagatcaca     420
taccggagag gttttgcctc agctgctctc aactttgtaa tcttgtgaag aagctgacaa     480
gcttggctga ttgcagagca ctatgaggac tgaacgacag tgggttttaa ttcagatatt     540
tcaagtgttg tgcgggttaa tacaacaaac tgtaacaagt gtacctggta tggacttgtt     600
gtccgggacg tacattttcg cggtcctgct agcatgcgtg gtgttccact ctggcgccca     660
ggagaaaaac tacaccatcc gagaagaaat gccagaaaac gtcctgatag gcgacttgtt     720
gaaagacctt aacttgtcgc tgattccaaa caagtccttg acaactgcta tgcagttcaa     780
gctagtgtac aagaccggag atgtgccact gattcgaatt gaagaggata ctggtgagat     840
cttcactact ggcgctcgca ttgatcgtga gaaattatgt gctggtatcc caagggatga     900
gcattgcttt tatgaagtgg aggttgccat tttgccggat gaaatattta gactggttaa     960
gatacgtttt ctgatagaag atataaatga taatgcacca ttgttcccag caacagttat    1020
caacatatca attccagaga actcggctat aaactctaaa tatactctcc cagcggctgt    1080
tgatcctgac gtaggaataa acggagttca aaactacgaa ctaattaaga gtcaaaacat    1140
ttttggcctc gatgtcattg aaacaccaga aggagacaag atgccacaac tgattgttca    1200
aaaggagtta gatagggaag agaaggatac ctacgtgatg aaagtaaagg ttgaagatgg    1260
tggctttcct caaagatcca gtactgctat tttgcaagtg agtgttactg atacaaatga    1320
caaccaccca gtctttaagg agacagagat tgaagtcagt ataccagaaa atgctcctgt    1380
aggcacttca gtgacacagc tccatgccac agatgctgac ataggtgaaa atgccaagat    1440
ccacttctct ttcagcaatc tagtctccaa cattgccagg agattatttc acctcaatgc    1500
caccactgga cttatcacaa tcaaagaacc actggatagg gaagaaacac caaaccacaa    1560
gttactggtt ttggcaagtg atggtggatt gatgccagca agagcaatgg tgctggtaaa    1620
tgttacagat gtcaatgata atgtcccatc cattgacata agatacatcg tcaatcctgt    1680
caatgacaca gttgttcttt cagaaaatat tccactcaac accaaaattg ctctcataac    1740
tgtgacggat aaggatgcgg accataatgg cagggtgaca tgcttcacag atcatgaaat    1800
ccctttcaga ttaaggccag tattcagtaa tcagttcctc ctggagactg cagcatatct    1860
tgactatgag tccacaaaag aatatgccat taaattactg gctgcagatg ctggcaaacc    1920
tcctttgaat cagtcagcaa tgctcttcat caaagtgaaa gatgaaaatg acaatgctcc    1980
agttttcacc cagtctttcg taactgtttc tattcctgag aataactctc ctggcatcca    2040
gttgacgaaa gtaagtgcaa tggatgcaga cagtgggcct aatgctaaga tcaattacct    2100
gctaggccct gatgctccac ctgaattcag cctggattgt cgtacaggca tgctgactgt    2160
agtgaagaaa ctagatagag aaaaagagga taaatattta ttcacaattc tggcaaaaga    2220
```

Figure 11c (continued)

```
taacggggta ccacccttaa ccagcaatgt cacagtcttt gtaagcatta ttgatcagaa    2280
tgacaatagc ccagttttca ctcacaatga atacaacttc tatgtcccag aaaaccttcc    2340
aaggcatggt acagtaggac taatcactgt aactgatcct gattatggag acaattctgc    2400
agttacgctc tccattttag atgagaatga tgacttcacc attgattcac aaactggtgt    2460
catccgacca aatatttcat ttgatagaga aaaacaagaa tcttacactt tctatgtaaa    2520
ggctgaggat ggtggtagag tatcacgttc ttcaagtgcc aaagtaacca taaatgtggt    2580
tgatgtcaat gacaacaaac cagttttcat tgtccctcct tccaactgtt cttatgaatt    2640
ggttctaccg tccactaatc caggcacagt ggtctttcag gtaattgctg ttgacaatga    2700
cactggcatg aatgcagagg ttcgttacag cattgtagga ggaaacacaa gagatctgtt    2760
tgcaatcgac caagaaacag gcaacataac attgatggag aaatgtgatg ttacagacct    2820
tggtttacac agagtgttgg tcaaagctaa tgacttagga cagcctgatt ctctcttcag    2880
tgttgtaatt gtcaatctgt tcgtgaatga gtcggtgacc aatgctacac tgattaatga    2940
actggtgcgc aaaagcactg aagcaccagt gaccccaaat actgagatag ctgatgtatc    3000
ctcaccaact agtgactatg tcaagatcct ggttgcagct gttgctggca ccataactgt    3060
cgttgtagtt attttcatca ctgctgtagt aagatgtcgc caggcaccac accttaaggc    3120
tgctcagaaa aacaagcaga attctgaatg ggctacccca aacccagaaa acaggcagat    3180
gataatgatg aagaaaaaga aaaagaagaa gaagcattcc cctaagaact tgctgcttaa    3240
ttttgtcact attgaagaaa ctaaggcaga tgatgttgac agtgatggaa acagagtcac    3300
actagacctt cctattgatc tagaagagca aacaatggga aagtacaatt gggtaactac    3360
acctactact ttcaagcccg acagccctga tttggcccga cactacaaat ctgcctctcc    3420
acagcctgcc ttccaaattc agcctgaaac tcccctgaat tcgaagcacc acatcatcca    3480
agaactgcct ctcgataaca cctttgtggc ctgtgactct atctccaagt gttcctcaag    3540
cagttcagat ccctacagcg tttctgactg tggctatcca gtgacgacct tcgaggtacc    3600
tgtgtccgta cacaccagac cgactgattc caggacatca actattgaaa tctgcagtga    3660
gatataactt tctaggaaca acaaaattcc attccccttc caaaaaattt caatgattgt    3720
gatttcaaaa ttaggctaag atcattaatt ttgtaatcta gatttcccat tataaaagca    3780
agcaaaaatc atcttaaaaa tgatgtccta gtgaaccttg tgctttcttt agctgtaatc    3840
tggcaatgga aatttaaaat ttatggaaga gacagtgcag cacaataaca gagtactctc    3900
atgctgtttc tctgtttgct ctgaatcaac agccatgatg taatataagg ctgtcttggt    3960
gtatacactt atggttaata tatcagtcat gaaacatgca attacttgcc ctgtctgatt    4020
gttgaataat taaaacatta tctccaggag tttggaagtg agctgaacta gccaaactac    4080
tctctgaaag gtatccaggg caagagacat ttttaagacc ccaaacaaac aaaaaacaaa    4140
accaaaacac tctggttcag tgttttgaaa atattcacta acataatatt gctgagaaaa    4200
tcatttttat tacccaccac tctgcttaaa agttgagtgg gccgggcgcg gtggctcacg    4260
cctgtaatcc cagcactttg ggaggccgag gcgggtggat cacgaggtca ggagattgag    4320
accatcctgg ctaacacggt gaaaccccat ctccactaaa aatacaaaaa attagcctgg    4380
cgtggtggcg ggcgcctgta gtcccagcta ctcgggaggc tgaggcagga gaatagcgtg    4440
aacccgggag gcggagcttg cagtgagccg agatggcgcc actgcactcc agcctgggtg    4500
acagagcaag actctgtctc aaaaagaaaa aaatgttcaa tgatagaaaa taattttact    4560
```

Figure 11c (continued)

```
aggtttttat gttgattgta ctcatgctgt tccactcctt ttaattatta aaaagttatt    4620
tttggctggg tgtggtggct cacacctgta atcccagcac tttgggaggc cgaggtgggt    4680
ggatcacctg aggtcaggag ttcaagacca gtctggccaa cat                      4723
```

>109P1D4 v.3 (SEQ ID NO:126)

```
ctggtggtcc agtacctcca aagatatgga atacactcct gaaatatcct gaaaactttt      60
tttttttcaga atcctttaat aagcagttat gtcaatctga aagttgctta cttgtacttt    120
atattaatag ctattcttgt tttttcttatc caaagaaaaa tcctctaatc ccttttttcac   180
atgatagttg ttaccatgtt taggcattag tcacatcaac ccctctcctc tcccaaactt     240
ctcttcttca aatcaaactt tattagtccc tcctttataa tgattccttg cctcgtttta     300
tccagatcaa ttttttttca ctttgatgcc cagagctgaa gaaatggact actgtataaa     360
ttattcattg ccaagagaat aattgcattt taaacccata ttataacaaa gaataatgat     420
tatattttgt gatttgtaac aaatacccctt tattttccct taactattga attaaatatt    480
ttaattattt gtattctctt taactatctt ggtatattaa agtattatct tttatatatt     540
tatcaatggt ggacactttt ataggtactc tgtgtcattt ttgatactgt aggtatctta     600
tttcatttat ctttattctt aatgtacgaa ttcataatat ttgattcaga acaaatttat     660
cactaattaa cagagtgtca attatgctaa catctcattt actgatttta atttaaaaca     720
gtttttgtta acatgcatgt ttagggttgg cttcttaata atttcttctt cctcttctct     780
ctctcctctt cttttggtca gtgttgtgcg ggttaataca acaaactgta acaagtgtac     840
ctggtatgga cttgttgtcc gggacgtaca ttttcgcggt cctgctagca tgcgtggtgt     900
tccactctgg cgcccaggag aaaaactaca ccatccgaga agaaatgcca gaaaacgtcc     960
tgataggcga cttgttgaaa gaccttaact tgtcgctgat tccaaacaag tccttgacaa    1020
ctgctatgca gttcaagcta gtgtacaaga ccggagatgt gccactgatt cgaattgaag    1080
aggatactgg tgagatcttc actactggcg ctcgcattga tcgtgagaaa ttatgtgctg    1140
gtatcccaag ggatgagcat tgcttttatg aagtggaggt tgccattttg ccggatgaaa    1200
tatttagact ggttaagata cgttttctga tagaagatat aaatgataat gcaccattgt    1260
tcccagcaac agttatcaac atatcaattc cagagaactc ggctataaac tctaaatata    1320
ctctcccagc ggctgttgat cctgacgtag gaataaacgg agttcaaaac tacgaactaa    1380
ttaagagtca aaacattttt ggcctcgatg tcattgaaac accagaagga gacaagatgc    1440
cacaactgat tgttcaaaag gagttagata gggaagagaa ggatacctac gtgatgaaag    1500
taaaggttga agatggtggc tttcctcaaa gatccagtac tgctattttg caagtgagtg    1560
ttactgatac aaatgacaac cacccagtct ttaaggagac agagattgaa gtcagtatac    1620
cagaaaatgc tcctgtaggc acttcagtga cacagctcca tgccacagat gctgacatag    1680
gtgaaaatgc caagatccac ttctctttca gcaatctagt ctccaacatt gccaggagat    1740
tatttcacct caatgccacc actggactta tcacaatcaa agaaccactg gatagggaag    1800
aaacaccaaa ccacaagtta ctggttttgg caagtgatgg tggattgatg ccagcaagag    1860
caatggtgct ggtaaatgtt acagatgtca atgataatgt cccatccatt gacataagat    1920
acatcgtcaa tcctgtcaat gacacagttg ttctttcaga aaatattcca ctcaacacca    1980
```

Figure 11c (continued)

```
aaattgctct cataactgtg acggataagg atgcggacca taatggcagg gtgacatgct    2040
tcacagatca tgaaatccct ttcagattaa ggccagtatt cagtaatcag ttcctcctgg    2100
agactgcagc atatcttgac tatgagtcca caaaagaata tgccattaaa ttactggctg    2160
cagatgctgg caaacctcct ttgaatcagt cagcaatgct cttcatcaaa gtgaaagatg    2220
aaaatgacaa tgctccagtt ttcacccagt ctttcgtaac tgtttctatt cctgagaata    2280
actctcctgg catccagttg acgaaagtaa gtgcaatgga tgcagacagt gggcctaatg    2340
ctaagatcaa ttacctgcta ggccctgatg ctccacctga attcagcctg gattgtcgta    2400
caggcatgct gactgtagtg aagaaactag atagagaaaa agaggataaa tatttattca    2460
caattctggc aaaagataac ggggtaccac ccttaaccag caatgtcaca gtctttgtaa    2520
gcattattga tcagaatgac aatagcccag ttttcactca caatgaatac aacttctatg    2580
tcccagaaaa ccttccaagg catggtacag taggactaat cactgtaact gatcctgatt    2640
atggagacaa ttctgcagtt acgctctcca ttttagatga gaatgatgac ttcaccattg    2700
attcacaaac tggtgtcatc cgaccaaata tttcatttga tagagaaaaa caagaatctt    2760
acactttcta tgtaaaggct gaggatggtg gtagagtatc acgttcttca agtgccaaag    2820
taaccataaa tgtggttgat gtcaatgaca acaaaccagt tttcattgtc cctccttcca    2880
actgttctta tgaattggtt ctaccgtcca ctaatccagg cacagtggtc tttcaggtaa    2940
ttgctgttga caatgacact ggcatgaatg cagaggttcg ttacagcatt gtaggaggaa    3000
acacaagaga tctgtttgca atcgaccaag aaacaggcaa cataacattg atggagaaat    3060
gtgatgttac agaccttggt ttacacagag tgttggtcaa agctaatgac ttaggacagc    3120
ctgattctct cttcagtgtt gtaattgtca atctgttcgt gaatgagtcg gtgaccaatg    3180
ctacactgat taatgaactg gtgcgcaaaa gcactgaagc accagtgacc ccaaatactg    3240
agatagctga tgtatcctca ccaactagtg actatgtcaa gatcctggtt gcagctgttg    3300
ctggcaccat aactgtcgtt gtagttattt tcatcactgc tgtagtaaga tgtcgccagg    3360
caccacacct taaggctgct cagaaaaaca agcagaattc tgaatgggct accccaaacc    3420
cagaaaacag gcagatgata atgatgaaga aaaagaaaaa gaagaagaag cattccccta    3480
agaacttgct gcttaatttt gtcactattg aagaaactaa ggcagatgat gttgacagtg    3540
atggaaacag agtcacacta gaccttccta ttgatctaga agagcaaaca atgggaaagt    3600
acaattgggt aactacacct actactttca agcccgacag ccctgatttg gcccgacact    3660
acaaatctgc ctctccacag cctgccttcc aaattcagcc tgaaactccc ctgaattcga    3720
agcaccacat catccaagaa ctgcctctcg ataacacctt tgtggcctgt gactctatct    3780
ccaagtgttc ctcaagcagt tcagatccct acagcgtttc tgactgtggc tatccagtga    3840
cgaccttcga ggtacctgtg tccgtacaca ccagaccgcc aatgaaggag gttgtgcgat    3900
cttgcacccc catgaaagag tctacaacta tggagatctg gattcatccc caaccacagc    3960
ggaaatctga agggaaagtg gcaggaaagt cccagcggcg tgtcacattt cacctgccag    4020
aaggctctca ggaaagcagc agtgatggtg gactgggaga ccatgatgca ggcagcctta    4080
ccagcacatc tcatggcctg ccccttggct atcctcagga ggagtacttt gatcgtgcta    4140
cacccagcaa tcgcactgaa ggggatggca actccgatcc tgaatctact ttcatacctg    4200
gactaaagaa agctgcagaa ataactgttc aaccaactgt ggaagaggcc tctgacaact    4260
gcactcaaga atgtctcatc tatggccatt ctgatgcctg ctggatgccg gcatctctgg    4320
```

Figure 11c (continued)

```
atcattccag ctcttcgcaa gcacaggcct ctgctctatg ccacagccca ccactgtcac    4380
aggcctctac tcagcaccac agcccacgag tgacacagac cattgctctc tgcccacagcc   4440
ctccagtgac acagaccatc gcattgtgcc acagcccacc accgatacag gtgtctgctc    4500
tccaccacag tcctcctcta gtgcaggcta ctgcacttca ccacagccca ccatcagcac    4560
aggcctcagc cctctgctac agccctcctt tagcacaggc tgctgcaatc agccacagct    4620
ctcctctgcc acaggttatt gccctccatc gtagtcaggc ccaatcatca gtcagtttgc    4680
agcaaggttg ggtgcaaggt gctgatgggc tatgctctgt tgatcaggga gtgcaaggta    4740
gtgcaacatc tcagttttac accatgtctg aaagacttca tcccagtgat gattcaatta    4800
aagtcattcc tttgacaacc ttcactccac gccaacaggc cagaccgtcc agaggtgatt    4860
cccccattat ggaagaacat cccttgtaaa gctaaaatag ttacttcaaa ttttcagaaa    4920
agatgtatat agtcaaaatt taagatacaa ttccaatgag tattctgatt atcagatttg    4980
taaataacta tgtaaataga aacagatacc agaataaatc tacagctaga cccttagtca    5040
atagttaacc aaaaaattgc aatttgttta attcagaatg tgtatttaaa aagaaaagga    5100
atttaacaat ttgcatcccc ttgtacagta aggcttatca tgacagagcg cactatttct    5160
gatgtacagt atttttttgtt gtttttatca tcatgtgcaa tattactgat ttgtttccat   5220
gctgattgtg tggaaccagt atgtagcaaa tggaaagcct agaaatatct tattttctaa    5280
gtttaccttt agtttaccta aacttttgtt cagataacgt taaaaggtat acgtactcta    5340
gcctttttttt gggctttctt tttgattttt gtttgttgtt ttcagttttt ttgttgttgt  5400
tagtgagtct cccttcaaaa tacgcagtag gtagtgtaaa tactgcttgt ttgtgtctct    5460
ctgctgtcat gttttctacc ttattccaat actatattgt tgataaaatt tgtatataca    5520
ttttcaataa agaatatgta taaactgtac agatctagat ctacaaccta tttctctact    5580
ctttagtaga gttcgagaca cagaagtgca ataactgccc taattaagca actatttgtt    5640
aaaaagggcc tctttttact ttaatagttt agtgtaaagt acatcagaaa taaagctgta    5700
tctgccattt taagcctgta gtccattatt acttgggtct ttacttctgg gaatttgtat    5760
gtaacagcct agaaaattaa aaggaggtgg atgcatccaa agcacgagtc acttaaaata    5820
tcgacggtaa actactattt tgtagagaaa ctcaggaaga tttaaatgtt gatttgacag    5880
ctcaataggc tgttaccaaa gggtgttcag taaaaataac aaatacatgt aactgtagat    5940
aaaaccatat actaaatcta taagactaag ggatttttgt tattctagct caacttactg    6000
aagaaaacca ctaataacaa caagaatatc aggaaggaac ttttcaagaa atgtaattat    6060
aaatctacat caaacagaat tttaaggaaa aatgcagagg gagaaataag gcacatgact    6120
gcttcttgca gtcaacaaga aataccaata acacacacag aacaaaaacc atcaaaatct    6180
catatatgaa ataaaatata ttcttctaag caaagaaaca gtactattca tagaaaacat    6240
tagttttctt ctgttgtctg ttatttcctt cttgtatcct cttaactggc cattatcttg    6300
tatgtgcaca ttttataaat gtacagaaac atcaccaact taattttctt ccatagcaaa    6360
actgagaaaa taccttgttt cagtataaca ctaaaccaag agacaattga tgtttaatgg    6420
gggcggttgg ggtggggggg ggagtcaata tctcctattg attaacttag acatagattt    6480
tgtaatgtat aacttgatat ttaatttatg attaaactgt gtgtaaattt tgtaacataa    6540
actgtggtaa ttgcataatt tcattggtga ggatttccac tgaatattga gaaagtttct    6600
tttcatgtgc ccagcaggtt aagtagcgtt ttcagaatat acattattcc catccattgt    6660
```

Figure 11c (continued)

```
aaagttcctt aagtcatatt tgactgggcg tgcagaataa cttcttaact tttaactatc    6720
agagtttgat taataaaatt aattaatgtt ttttctcctt cgtgttgtta atgttccaag    6780
ggatttggag catactggtt ttccaggtgc atgtgaatcc cgaaggactg atgatatttg    6840
aatgtttatt aaattattat catacaaatg tgttgatatt gtggctattg ttgatgttga    6900
aaattttaaa cttggggaag attaagaaaa gaaccaatag tgacaaaaat cagtgcttcc    6960
agtagatttt agaacattct ttgcctcaaa aaacctgcaa agatgatgtg agatttttc    7020
ttgtgtttta attattttca cattttctct ctgcaaaact ttagttttct gatgatctac    7080
acacacacac acacacacac gtgcacacac acacacattt aaatgatata aaaagaagag    7140
gttgaaagat tattaaataa cttatcaggc atctcaatgg ttactatcta tgttagtgaa    7200
aatcaaatag gactcaaagt tggatatttg ggatttttct tctgacagta taatttattg    7260
agttactagg gaggttctta aatcctcata tctggaaact tgtgacgttt tgacaccttt    7320
cctatagatg atataggaat gaaccaatac gcttttatta ccctttctaa ctctgatttt    7380
ataatcagac ttagattgtg tttagaatat taaatgactg ggcaccctct tcttggtttt    7440
taccagagag gctttgaatg gaagcaggct gagagtagcc aaagaggcaa ggggtattag    7500
cccagttatt ctcccctatg ccttccttct ctttctaagc gtccactagg tctggccttg    7560
gaaacctgtt acttctaggg cttcagatct gatgatatct ttttcatcac attacaagtt    7620
atttctctga ctgaatagac agtggtatag gttgacacag cacacaagtg gctattgtga    7680
tgtatgatgt atgtagtcct acaactgcaa aacgtcttac tgaaccaaca atcaaaaaat    7740
ggttctgttt taaaaaggat tttgtttgat ttgaaattaa aacttcaagc tgaatgactt    7800
atatgagaat aatacgttca atcaaagtag ttattctatt ttgtgtccat attccattag    7860
attgtgatta ttaattttct agctatggta ttactatatc acacttgtga gtatgtattc    7920
aaatactaag tatcttatat gctacgtgca tacacattct tttcttaaac tttacctgtg    7980
ttttaactaa tattgtgtca gtgtattaaa aattagcttt tacatatgat atctacaatg    8040
taataaattt agagagtaat tttgtgtatt cttatttact taacatttta cttttaatta    8100
tgtaaatttg gttagaaaat aataataaat ggttagtgct attgtgtaat ggtagcagtt    8160
acaaagagcc tctgccttcc caaactaata tttatcacac atggtcatta aatgggaaaa    8220
aaatagacta aacaaatcac aaattgttca gttcttaaaa tgtaattatg tcacacacac    8280
aaaaaatcct tttcaatcct gagaaaatta aaggcgtttt actcacatgg ctatttcaac    8340
attagttttt tttgtttgtt tctttttcat ggtattactg aaggtgtgta tactccctaa    8400
tacacattta tgaaaatcta cttgtttagg cttttattta tactcttctg atttatattt    8460
tttattataa ttattatttc ttatcttttct tcttttatat tttttggaaa ccaaatttat    8520
agttagttta ggtaaacttt ttattatgac cattagaaac tattttgaat gcttccaact    8580
ggctcaattg gccgggaaaa catgggagca agagaagctg aaatatattt ctgcaagaac    8640
ctttctatat tatgtgccaa ttaccacacc agatcaattt tatgcagagg ccttaaaata    8700
ttctttcaca gtagctttct tacactaacc gtcatgtgct tttagtaaat atgattttta    8760
aaagcagttc aagttgacaa cagcagaaac agtaacaaaa aaatctgctc agaaaaatgt    8820
atgtgcacaa ataaaaaaaa ttaatggcaa ttgtttagtg attgtaagtg atacttttta    8880
aagagtaaac tgtgtgaaat ttatactatc cctgcttaaa atattaagat ttttatgaaa    8940
tatgtattta tgtttgtatt gtgggaagat tcctcctctg tgatatcata cagcatctga    9000
```

Figure 11c (continued)

```
aagtgaacag tatcccaaag cagttccaac catgctttgg aagtaagaag gttgactatt    9060
gtatggccaa ggatggcagt atgtaatcca gaagcaaact tgtattaatt gttctatttc    9120
aggttctgta ttgcatgttt tcttattaat atatattaat aaaagttatg agaaataaaa    9180
aaaaaaaaaa aaaaaa                                                    9196
```

>109P1D4 v.4 (SEQ ID NO:127)

```
ctggtggtcc agtacctcca aagatatgga atacactcct gaaatatcct gaaaactttt      60
tttttcaga atcctttaat aagcagttat gtcaatctga aagttgctta cttgtacttt      120
atattaatag ctattcttgt ttttcttatc caaagaaaaa tcctctaatc ccctttttcac   180
atgatagttg ttaccatgtt taggcattag tcacatcaac ccctctcctc tcccaaactt    240
ctcttcttca aatcaaactt tattagtccc tcctttataa tgattccttg cctcgtttta    300
tccagatcaa tttttttca ctttgatgcc cagagctgaa gaaatggact actgtataaa     360
ttattcattg ccaagagaat aattgcattt taaacccata ttataacaaa gaataatgat    420
tatattttgt gatttgtaac aaatacccttt tattttccct taactattga attaaatatt   480
ttaattattt gtattctctt taactatctt ggtatattaa agtattatct tttatatatt    540
tatcaatggt ggacactttt ataggtactc tgtgtcattt ttgatactgt aggtatctta    600
tttcatttat ctttattctt aatgtacgaa ttcataatat ttgattcaga acaaatttat    660
cactaattaa cagagtgtca attatgctaa catctcattt actgatttta atttaaaaca    720
gtttttgtta acatgcatgt ttagggttgg cttcttaata atttcttctt cctcttctct    780
ctctcctctt cttttggtca gtgttgtgcg ggttaataca acaaactgta acaagtgtac    840
ctggtatgga cttgttgtcc gggacgtaca ttttcgcggt cctgctagca tgcgtggtgt    900
tccactctgg cgcccaggag aaaaactaca ccatccgaga agaaatgcca gaaaacgtcc    960
tgataggcga cttgttgaaa gaccttaact tgtcgctgat tccaaacaag tccttgacaa   1020
ctgctatgca gttcaagcta gtgtacaaga ccggagatgt gccactgatt cgaattgaag   1080
aggatactgg tgagatcttc actactggcg ctcgcattga tcgtgagaaa ttatgtgctg   1140
gtatcccaag ggatgagcat tgcttttatg aagtggaggt tgccattttg ccggatgaaa   1200
tatttagact ggttaagata cgtttctga tagaagatat aaatgataat gcaccattgt    1260
tcccagcaac agttatcaac atatcaattc cagagaactc ggctataaac tctaaatata   1320
ctctcccagc ggctgttgat cctgacgtag gaataaacgg agttcaaaac tacgaactaa   1380
ttaagagtca aaacattttt ggcctcgatg tcattgaaac accagaagga gacaagatgc   1440
cacaactgat tgttcaaaag gagttagata gggaagagaa ggatacctac gtgatgaaag   1500
taaaggttga agatggtggc tttcctcaaa gatccagtac tgctattttg caagtgagtg   1560
ttactgatac aaatgacaac cacccagtct ttaaggagac agagattgaa gtcagtatac   1620
cagaaaatgc tcctgtaggc acttcagtga cacagctcca tgccacagat gctgacatag   1680
gtgaaaatgc caagatccac ttctctttca gcaatctagt ctccaacatt gccaggagat   1740
tatttcacct caatgccacc actggactta tcacaatcaa agaaccactg gatagggaag   1800
aaacaccaaa ccacaagtta ctggttttgg caagtgatgg tggattgatg ccagcaagag   1860
caatggtgct ggtaaatgtt acagatgtca atgataatgt cccatccatt gacataagat   1920
```

Figure 11c (continued)

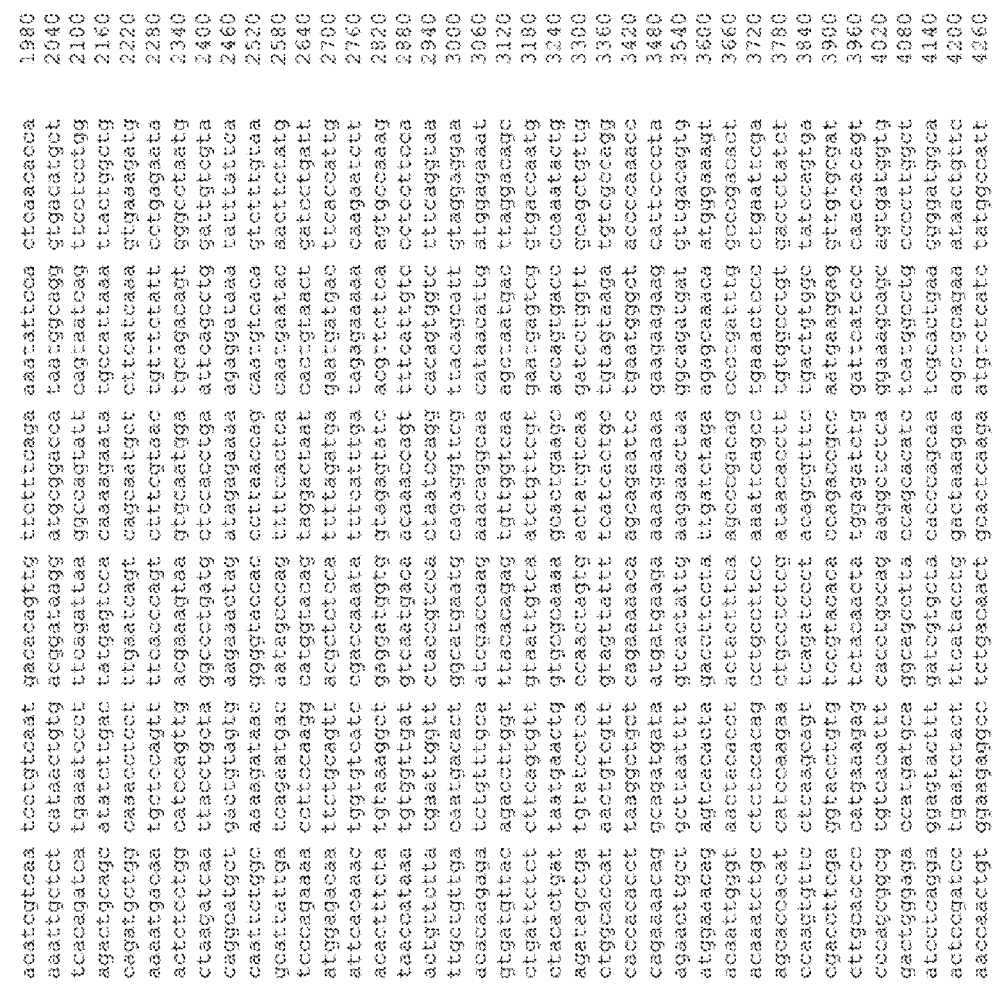

```
acatcgtcaa tcctgtcaat gacacagttg ttctttcaga aaatattcca ctcaacacca     1980
aaattgctct cataactgtg acggataagg atgcggacca taatggcagg gtgacatgct     2040
tcacagatca tgaaatccct ttcagattaa ggccagtatt cagtaatcag ttcctcctgg     2100
agactgcagc atatcttgac tatgagtcca caaaagaata tgccattaaa ttactggctg     2160
cagatgctgg caaacctcct ttgaatcagt cagcaatgct cttcatcaaa gtgaaagatg     2220
aaaatgacaa tgctccagtt ttcacccagt ctttcgtaac tgtttctatt cctgagaata     2280
actctcctgg catccagttg acgaaagtaa gtgcaatgga tgcagacagt gggcctaatg     2340
ctaagatcaa ttacctgcta ggccctgatg ctccacctga attcagcctg gattgtcgta     2400
caggcatgct gactgtagtg aagaaactag atagagaaaa agaggataaa tatttattca     2460
caattctggc aaaagataac ggggtaccac ccttaaccag caatgtcaca gtctttgtaa     2520
gcattattga tcagaatgac aatagcccag ttttcactca caatgaatac aacttctatg     2580
tcccagaaaa ccttccaagg catggtacag taggactaat cactgtaact gatcctgatt     2640
atggagacaa ttctgcagtt acgctctcca ttttagatga gaatgatgac ttcaccattg     2700
attcacaaac tggtgtcatc cgaccaaata tttcatttga tagagaaaaa caagaatctt     2760
acactttcta tgtaaaggct gaggatggtg gtagagtatc acgttcttca agtgccaaag     2820
taaccataaa tgtggttgat gtcaatgaca acaaaccagt tttcattgtc cctccttcca     2880
actgttctta tgaattggtt ctaccgtcca ctaatccagg cacagtggtc tttcaggtaa     2940
ttgctgttga caatgacact ggcatgaatg cagaggttcg ttacagcatt gtaggaggaa     3000
acacaagaga tctgtttgca atcgaccaag aaacaggcaa cataacattg atggagaaat     3060
gtgatgttac agaccttggt ttacacagag tgttggtcaa agctaatgac ttaggacagc     3120
ctgattctct cttcagtgtt gtaattgtca atctgttcgt gaatgagtcg gtgaccaatg     3180
ctacactgat taatgaactg gtgcgcaaaa gcactgaagc accagtgacc ccaaatactg     3240
agatagctga tgtatcctca ccaactagtg actatgtcaa gatcctggtt gcagctgttg     3300
ctggcaccat aactgtcgtt gtagttattt tcatcactgc tgtagtaaga tgtcgccagg     3360
cacccacacct taaggctgct cagaaaaaca agcagaattc tgaatgggct accccaaacc     3420
cagaaaacag gcagatgata atgatgaaga aaaagaaaaa gaagaagaag cattccccta     3480
agaacttgct gcttaatttt gtcactattg aagaaactaa ggcagatgat gttgacagtg     3540
atggaaacag agtcacacta gaccttccta ttgatctaga agagcaaaca atgggaaagt     3600
acaattgggt aactacacct actactttca agcccgacag ccctgatttg gcccgacact     3660
acaaatctgc ctctccacag cctgccttcc aaattcagcc tgaaactccc ctgaattcga     3720
agcaccacat catccaagaa ctgcctctcg ataacacctt tgtggcctgt gactctatct     3780
ccaagtgttc ctcaagcagt tcagatccct acagcgtttc tgactgtggc tatccagtga     3840
cgaccttcga ggtacctgtg tccgtacaca ccagaccgcc aatgaaggag gttgtgcgat     3900
cttgcacccc catgaaagag tctacaacta tggagatctg gattcatccc caacccacagt     3960
cccagcggcg tgtcacattt cacctgccag aaggctctca ggaaagcagc agtgatggtg     4020
gactgggaga ccatgatgca ggcagcctta ccagcacatc tcatggcctg cccottggct     4080
atcctcagga ggagtacttt gatcgtgcta cacccagcaa tcgcactgaa ggggatggca     4140
actccgatcc tgaatctact ttcatacctg gactaaagaa agctgcagaa ataactgttc     4200
aaccaactgt ggaagaggcc tctgacaact gcactcaaga atgtctcatc tatggccatt     4260
```

Figure 11c (continued)

```
ctgatgcctg ctggatgccg gcatctctgg atcattccag ctcttcgcaa gcacaggcct     4320
ctgctctatg ccacagccca ccactgtcac aggcctctac tcagcaccac agcccacgag     4380
tgacacagac cattgctctc tgccacagcc ctccagtgac acagaccatc gcattgtgcc     4440
acagcccacc accgatacag gtgtctgctc tccaccacag tcctcctcta gtgcaggcta     4500
ctgcacttca ccacagccca ccatcagcac aggcctcagc cctctgctac agccctcctt     4560
tagcacaggc tgctgcaatc agccacagct ctcctctgcc acaggttatt gccctccatc     4620
gtagtcaggc ccaatcatca gtcagtttgc agcaaggttg ggtgcaaggt gctgatgggc     4680
tatgctctgt tgatcaggga gtgcaaggta gtgcaacatc tcagttttac accatgtctg     4740
aaagacttca tcccagtgat gattcaatta aagtcattcc tttgacaacc ttcactccac     4800
gccaacaggc cagaccgtcc agaggtgatt cccccattat ggaagaacat cccttgtaaa     4860
gctaaaatag ttacttcaaa ttttcagaaa agatgtatat agtcaaaatt taagatacaa     4920
ttccaatgag tattctgatt atcagatttg taaataacta tgtaaataga aacagatacc     4980
agaataaatc tacagctaga cccttagtca atagttaacc aaaaaattgc aatttgttta     5040
attcagaatg tgtatttaaa aagaaaagga atttaacaat ttgcatcccc ttgtacagta     5100
aggcttatca tgacagagcg cactatttct gatgtacagt atttttgtt gtttttatca      5160
tcatgtgcaa tattactgat ttgtttccat gctgattgtg tggaaccagt atgtagcaaa     5220
tggaaagcct agaaatatct tattttctaa gtttaccttt agtttaccta aacttttgtt     5280
cagataacgt taaaaggtat acgtactcta gcctttttt gggctttctt tttgattttt      5340
gtttgttgtt ttcagttttt ttgttgttgt tagtgagtct cccttcaaaa tacgcagtag     5400
gtagtgtaaa tactgcttgt ttgtgtctct ctgctgtcat gttttctacc ttattccaat     5460
actatattgt tgataaaatt tgtatataca ttttcaataa agaatatgta taaactgtac     5520
agatctagat ctacaaccta tttctctact ctttagtaga gttcgagaca cagaagtgca     5580
ataactgccc taattaagca actatttgtt aaaaagggcc tctttttact ttaatagttt     5640
agtgtaaagt acatcagaaa taaagctgta tctgccattt taagcctgta gtccattatt     5700
acttgggtct ttacttctgg gaatttgtat gtaacagcct agaaaattaa aaggaggtgg     5760
atgcatccaa agcacgagtc acttaaaata tcgacggtaa actactattt tgtagagaaa     5820
ctcaggaaga tttaaatgtt gatttgacag ctcaataggc tgttaccaaa gggtgttcag     5880
taaaaataac aaatacatgt aactgtagat aaaaccatat actaaatcta taagactaag     5940
ggatttttgt tattctagct caacttactg aagaaaacca ctaataacaa caagaatatc     6000
aggaaggaac ttttcaagaa atgtaattat aaatctacat caaacagaat tttaaggaaa     6060
aatgcagagg gagaaataag gcacatgact gcttcttgca gtcaacaaga aataccaata     6120
acacacacag aacaaaaacc atcaaaatct catatatgaa ataaaatata ttcttctaag     6180
caaagaaaca gtactattca tagaaaacat tagttttctt ctgttgtctg ttatttcctt     6240
cttgtatcct cttaactggc cattatcttg tatgtgcaca ttttataaat gtacagaaac     6300
atcaccaact taattttctt ccatagcaaa actgagaaaa taccttgttt cagtataaca     6360
ctaaaccaag agacaattga tgtttaatgg gggcggttgg ggtggggggg ggagtcaata     6420
tctcctattg attaacttag acatagattt tgtaatgtat aacttgatat ttaatttatg     6480
attaaactgt gtgtaaattt tgtaacataa actgtggtaa ttgcataatt tcattggtga     6540
ggatttccac tgaatattga gaaagtttct tttcatgtgc ccagcaggtt aagtagcgtt     6600
```

Figure 11c (continued)

```
ttcagaatat acattattcc catccattgt aaagttcctt aagtcatatt tgactgggcg     6660
tgcagaataa cttcttaact tttaactatc agagtttgat taataaaatt aattaatgtt     6720
ttttctcctt cgtgttgtta atgttccaag ggatttggag catactggtt ttccaggtgc     6780
atgtgaatcc cgaaggactg atgatatttg aatgtttatt aaattattat catacaaatg     6840
tgttgatatt gtggctattg ttgatgttga aaattttaaa cttggggaag attaagaaaa     6900
gaaccaatag tgacaaaaat cagtgcttcc agtagatttt agaacattct ttgcctcaaa     6960
aaacctgcaa agatgatgtg agatttttc ttgtgtttta attattttca cattttctct     7020
ctgcaaaact ttagttttct gatgatctac acacacacac acacacacac gtgcacacac     7080
acacacattt aaatgatata aaaagaagag gttgaaagat tattaaataa cttatcaggc     7140
atctcaatgg ttactatcta tgttagtgaa aatcaaatag gactcaaagt tggatatttg     7200
ggatttttct tctgacagta taatttattg agttactagg gaggttctta aatcctcata     7260
tctggaaact tgtgacgttt tgacaccttt cctatagatg atataggaat gaaccaatac     7320
gcttttatta ccctttctaa ctctgatttt ataatcagac ttagattgtg tttagaatat     7380
taaatgactg ggcaccctct tcttggtttt taccagagag gctttgaatg gaagcaggct     7440
gagagtagcc aaagaggcaa ggggtattag cccagttatt ctcccctatg ccttccttct     7500
ctttctaagc gtccactagg tctggccttg gaaacctgtt acttctaggg cttcagatct     7560
gatgatatct ttttcatcac attacaagtt atttctctga ctgaatagac agtggtatag     7620
gttgacacag cacacaagtg gctattgtga tgtatgatgt atgtagtcct acaactgcaa     7680
aacgtcttac tgaaccaaca atcaaaaaat ggttctgttt taaaaaggat tttgtttgat     7740
ttgaaattaa aacttcaagc tgaatgactt atatgagaat aatacgttca atcaaagtag     7800
ttattctatt ttgtgtccat attccattag attgtgatta ttaattttct agctatggta     7860
ttactatatc acacttgtga gtatgtattc aaatactaag tatcttatat gctacgtgca     7920
tacacattct tttcttaaac tttacctgtg ttttaactaa tattgtgtca gtgtattaaa     7980
aattagcttt tacatatgat atctacaatg taataaattt agagagtaat tttgtgtatt     8040
cttatttact taacatttta cttttaatta tgtaaatttg gttagaaaat aataataaat     8100
ggttagtgct attgtgtaat ggtagcagtt acaaagagcc tctgccttcc caaactaata     8160
tttatcacac atggtcatta aatgggaaaa aaatagacta aacaaatcac aaattgttca     8220
gttcttaaaa tgtaattatg tcacacacac aaaaaatcct tttcaatcct gagaaaatta     8280
aaggcgtttt actcacatgg ctatttcaac attagttttt tttgtttgtt tctttttcat     8340
ggtattactg aaggtgtgta tactccctaa tacacattta tgaaaatcta cttgtttagg     8400
cttttattta tactcttctg atttatattt tttattataa ttattatttc ttatctttct     8460
tcttttatat tttttggaaa ccaaatttat agttagttta ggtaaacttt ttattatgac     8520
cattagaaac tattttgaat gcttccaact ggctcaattg gccgggaaaa catgggagca     8580
agagaagctg aaatatattt ctgcaagaac ctttctatat tatgtgccaa ttaccacacc     8640
agatcaattt tatgcagagg ccttaaaata ttctttcaca gtagctttct tacactaacc     8700
gtcatgtgct tttagtaaat atgattttta aaagcagttc aagttgacaa cagcagaaac     8760
agtaacaaaa aaatctgctc agaaaaatgt atgtgcacaa ataaaaaaaa ttaatggcaa     8820
ttgtttagtg attgtaagtg atactttttta aagagtaaac tgtgtgaaat ttatactatc     8880
cctgcttaaa atattaagat ttttatgaaa tatgtattta tgtttgtatt gtgggaagat     8940
```

Figure 11c (continued)

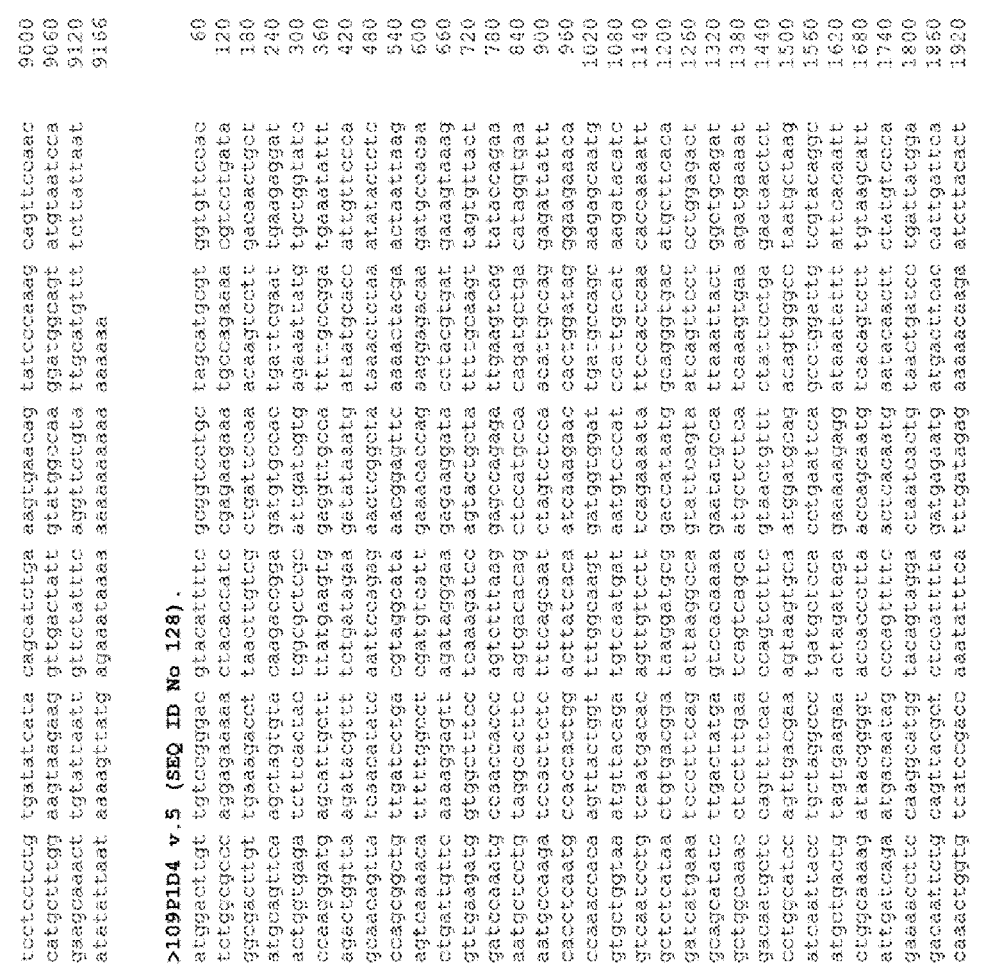

```
tcctcctctg tgatatcata cagcatctga aagtgaacag tatcccaaag cagttccaac    9000
catgctttgg aagtaagaag gttgactatt gtatggccaa ggatggcagt atgtaatcca    9060
gaagcaaact tgtattaatt gttctatttc aggttctgta ttgcatgttt tcttattaat    9120
atatattaat aaaagttatg agaaataaaa aaaaaaaaaa aaaaaa                   9166
```

>109P1D4 v.5 (SEQ ID No 128).

```
atggacttgt tgtccgggac gtacattttc gcggtcctgc tagcatgcgt ggtgttccac      60
tctggcgccc aggagaaaaa ctacaccatc cgagaagaaa tgccagaaaa cgtcctgata     120
ggcgacttgt tgaaagacct taacttgtcg ctgattccaa acaagtcctt gacaactgct     180
atgcagttca agctagtgta caagaccgga gatgtgccac tgattcgaat tgaagaggat     240
actggtgaga tcttcactac tggcgctcgc attgatcgtg agaaattatg tgctggtatc     300
ccaaggggatg agcattgctt ttatgaagtg gaggttgcca ttttgccgga tgaaatattt     360
agactggtta agatacgttt tctgatagaa gatataaatg ataatgcacc attgttccca     420
gcaacagtta tcaacatatc aattccagag aactcggcta taaactctaa atatactctc     480
ccagcggctg ttgatcctga cgtaggcata aacggagttc aaaactacga actaattaag     540
agtcaaaaca tttttggcct cgatgtcatt gaaacaccag aaggagacaa gatgccacaa     600
ctgattgttc aaaaggagtt agatagggaa gagaaggata cctacgtgat gaaagtaaag     660
gttgaagatg gtggctttcc tcaaagatcc agtactgcta ttttgcaagt tagtgttact     720
gatccaaatg ccaaccaccc agtctttaag gagccagaga ttgaagtcag tataccagaa     780
aatgctcctg taggcacttc agtgacacag ctccatgcca cagatgctga cataggtgaa     840
aatgccaaga tccacttctc tttcagcaat ctagtctcca acattgccag gagattattt     900
cacctcaatg ccaccactgg acttatcaca atcaaagaac cactggatag ggaagaaaca     960
ccaaaccaca agttactggt tttggcaagt gatggtggat tgatgccagc aagagcaatg    1020
gtgctggtaa atgttacaga tgtcaatgat aatgtcccat ccattgacat aagatacatc    1080
gtcaatcctg tcaatgacac agttgttctt tcagaaaata ttccactcaa caccaaaatt    1140
gctctcataa ctgtgacgga taaggatgcg gaccataatg gcagggtgac atgcttcaca    1200
gatcatgaaa tccctttcag attaaggcca gtattcagta atcagttcct cctggagact    1260
gcagcatatc ttgactatga gtccacaaaa gaatatgcca ttaaattact ggctgcagat    1320
gctggcaaac ctcctttgaa tcagtcagca atgctcttca tcaaagtgaa agatgaaaat    1380
gacaatgctc cagttttcac ccagtctttc gtaactgttt ctattcctga gaataactct    1440
cctggcatcc agttgacgaa agtaagtgca atggatgcag acagtgggcc taatgctaag    1500
atcaattacc tgctaggccc tgatgctcca cctgaattca gcctggattg tcgtacaggc    1560
atgctgactg tagtgaagaa actagataga gaaaaagagg ataaatattt attcacaatt    1620
ctggcaaaag ataacggggt accacccttta accagcaatg tcacagtctt tgtaagcatt    1680
attgatcaga atgacaatag cccagttttc actcacaatg aatacaactt ctatgtccca    1740
gaaaaccttc caaggcatgg tacagtagga ctaatcactg taactgatcc tgattatgga    1800
gacaattctg cagttacgct ctccatttta gatgagaatg atgacttcac cattgattca    1860
caaactggtg tcatccgacc aaatatttca tttgatagag aaaaacaaga atcttacact    1920
```

Figure 11c (continued)

```
ttctatgtaa aggctgagga tggtggtaga gtatcacgtt cttcaagtgc caaagtaacc     1980
ataaatgtgg ttgatgtcaa tgacaacaaa ccagttttca ttgtccctcc ttccaactgt     2040
tcttatgaat tggttctacc gtccactaat ccaggcacag tggtctttca ggtaattgct     2100
gttgacaatg acactggcat gaatgcagag gttcgttaca gcattgtagg aggaaacaca     2160
agagatctgt ttgcaatcga ccaagaaaca ggcaacataa cattgatgga gaaatgtgat     2220
gttacagacc ttggtttaca cagagtgttg gtcaaagcta atgacttagg acagcctgat     2280
tctctcttca gtgttgtaat tgtcaatctg ttcgtgaatg agtcggtgac caatgctaca     2340
ctgattaatg aactggtgcg caaaagcact gaagcaccag tgaccccaaa tactgagata     2400
gctgatgtat cctcaccaac tagtgactat gtcaagatcc tggttgcagc tgttgctggc     2460
accataactg tcgttgtagt tattttcatc actgctgtag taagatgtcg ccaggcacca     2520
caccttaagg ctgctcagaa aaacaagcag aattctgaat gggctacccc aaacccagaa     2580
aacaggcaga tgataatgat gaagaaaaag aaaaagaaga agaagcattc ccctaagaac     2640
ttgctgctta attttgtcac tattgaagaa actaaggcag atgatgttga cagtgatgga     2700
aacagagtca cactagacct tcctattgat ctagaagagc aaacaatggg aaagtacaat     2760
tgggtaacta cacctactac tttcaagccc gacagccctg atttggcccg acactacaaa     2820
tctgcctctc cacagcctgc cttccaaatt cagcctgaaa ctcccctgaa ttcgaagcac     2880
cacatcatcc aagaactgcc tctcgataac acctttgtgg cctgtgactc tatctccaag     2940
tgttcctcaa gcagttcaga tccctacagc gtttctgact gtggctatcc agtgacgacc     3000
ttcgaggtac ctgtgtccgt acacaccaga ccgtcccagc ggcgtgtcac atttcacctg     3060
ccagaaggct ctcaggaaag cagcagtgat ggtggactgg gagaccatga tgcaggcagc     3120
cttaccagca catctcatgg cctgcccctt ggctatcctc aggaggagta ctttgatcgt     3180
gctacaccca gcaatcgcac tgaaggggat gggaactccg atcctgaatc tactttcata     3240
cctggactaa agaaagctgc agaaataact gttcaaccaa ctgtggaaga ggcctctgac     3300
aactgcactc aagaatgtct catctatggc cattctgatg cctgctggat gccggcatct     3360
ctggatcatt ccagctcttc gcaagcacag gcctctgctc tatgccacag cccaccactg     3420
tcacaggcct ctactcagca ccacagccca cgagtgacac agaccattgc tctctgccac     3480
agccctccag tgacacagac catcgcattg tgccacagcc caccacccgat acaggtgtct     3540
gctctccacc acagtcctcc tctagtgcag gctactgcac ttcaccacag cccaccatca     3600
gcacaggcct cagccctctg ctacagccct cctttagcac aggctgctgc aatcagccac     3660
agctctcctc tgccacaggt tattgccctc catcgtagtc aggcccaatc atcagtcagt     3720
ttgcagcaag gttgggtgca aggtgctgat gggctatgct ctgttgatca gggagtgcaa     3780
ggtagtgcaa catctcagtt ttacaccatg tctgaaagac ttcatcccag tgatgattca     3840
attaaagtca ttcctttgac aaccttcact ccacgccaac aggccagacc gtccagaggt     3900
gattccccca ttatggaaga acatcccttg taaagctaaa atagttactt caaattttca     3960
gaaaagatgt atatagtcaa aatttaagat acaattccaa tgagtattct gattatcaga     4020
tttgtaaata actatgtaaa tagaaacaga taccagaata a                         4061
```

Figure 11c (continued)

>109P1D4 v.6 (SEQ ID NO 129).

```
ggcagtcggc gaactgtctg ggcgggagga gccgtgagca gtagctgcac tcagctgccc     60
gcgcggcaaa gaggaaggca agccaaacag agtgcgcaga gtggcagtgc cagcggcgac    120
acaggcagca caggcagccc gggctgcctg aatagcctca gaaacaacct cagcgactcc    180
ggctgctctg cggactgcga gctgtggcgg tagagcccgc tacagcagtc gcagtctccg    240
tggagcgggc ggaagccttt tttctccctt tcgtttacct cttcattcta ctctaaaggc    300
atcgttatta gagggtgctt aaaaagtaca gatcaactgg atggatgaat ggatggaaga    360
ggatggaata tcttaacaaa acacattttc cttaagtaaa ttcatgcata ctccaaataa    420
aatacagaat gtgaagtatc tctgaactgt gctgttgaat atggtagcta ctagctacat    480
gaaaatcctg ttgtgaataa gaaggattcc acagatcaca taccagagcg gttttgcctc    540
agctgctctc aactttgtaa tcttgtgaag aagctgacaa gcttggctga ttgcagtgca    600
ctatgaggac tgaatgacag tgggttttaa ttcagatatt tcaagtgttg tgcgggttaa    660
tacaacaaac tgtcacaagt gtttgttgtc cgggacgtac attttcgcgg tcctgctagt    720
atgcgtggtg ttccactctg gcgcccagga gaaaaactac accatccgag aagaaattcc    780
agaaaacgtc ctgataggca acttgttgaa agaccttaac ttgtcgctga ttccaaacaa    840
gtccttgaca actactatgc agttcaagct agtgtacaag accggagatg tgccactgat    900
tcgaattgaa gaggatactg gtgagatctt cactaccggc gctcgcattg atcgtgagaa    960
attatgtgct ggtatcccaa gggatgagca ttgcttttat gaagtggagg ttgccatttt   1020
gccggatgaa atatttagac tggttaagat acgttttctg atagaagata taaatgataa   1080
tgcaccattg ttcccagcaa cagttatcaa catatcaatt ccagagaact cggctataaa   1140
ctctaaatat actctcccag cggctgttga tcctgacgta ggcataaacg gagttcaaaa   1200
ctacgaacta attaagagtc aaaacatttt tggcctcgat gtcattgaaa caccagaagg   1260
agacaagatg ccacaactga ttgttcaaaa ggagttagat agggaagaga aggataccta   1320
tgtgatgaaa gtaaaggttg aagatggtgg ctttcctcaa agatccagta ctgctatttt   1380
gcaagtaagt gttactgata caaatgacaa ccacccagtc tttaaggaga cagagattga   1440
agtcagtata ccagaaaatg ctcctgtagg cacttcagtg acacagctcc atgccacaga   1500
tgctgacata ggtgaaaatg ccaagatcca cttctctttc agcaatctag tctccaacat   1560
tgccaggaga ttatttcacc tcaatgccac cactggactt atcacaatca aagaaccact   1620
ggatagggaa gaaacaccaa accacaagtt actggttttg gcaagtgatg gtggattgat   1680
gccagcaaga gcaatggtgc tggtaaatgt tacagatgtc aatgataatg tcccatccat   1740
tgacataaga tacatcgtca atcctgtcaa tgacacagtt gttctttcag aaaatattcc   1800
actcaacacc aaaattgctc tcataactgt gacggataag gatgcggacc ataatggcag   1860
ggtgacatgc ttcacagatc atgaaattcc tttcagatta aggccagtat tcagtaatca   1920
gttcctcctg gagaatgcag catatcttga ctatgagtcc acaaaagaat atgccattaa   1980
attactggct gcagatgctg gcaaacctcc tttgaatcag tcagcaatgc tcttcatcaa   2040
agtgaaagat gaaaatgaca atgctccagt tttcacccag tctttcgtaa ctgtttctat   2100
tcctgagaat aactctcctg gcatccagtt gatgaaagta agtgcaacgg atgcagacag   2160
tgggcctaat gctgagatca attacctgct aggccctgat gctccacctg aattcagcct   2220
ggatcgtcgt acaggcatgc tgactgtagt gaagaaacta gatagagaaa aagaggataa   2280
```

Figure 11c (continued)

```
atatttattc acaattctgg caaaagataa tggggtacca cccttaacca gcaatgtcac     2340
agtctttgta agcattattg atcagaatga caatagccca gttttcactc acaatgaata     2400
caaattctat gtcccagaaa accttccaag gcatggtaca gtaggactaa tcactgtaac     2460
tgatcctgat tatggagaca attctgcagt tacgctctcc attttagatg agaatgatga     2520
cttcaccatt gattcacaaa ctggtgtcat ccgaccaaat atttcatttg atagagaaaa     2580
acaagaatct tacacttttct atgtaaaggc tgaggatggt ggtagagtat cacgttcttc     2640
aagtgccaaa gtaaccataa atgtggttga tgtcaatgac aacaaaccag ttttcattgt     2700
ccctccttac aactattctt atgaattggt tctaccgtcc actaatccag gcacagtggt     2760
ctttcaggta attgctgttg acaatgacac tggcatgaat gcagaggttc gttacagcat     2820
tgtaggagga aacacaagag atctgtttgc aatcgaccaa gaaacaggca acataacatt     2880
gatggagaaa tgtgatgtta cagaccttgg tttacacaga gtgttggtca aagctaatga     2940
cttaggacag cctgattctc tcttcagtgt tgtaattgtc aatctgttcg tgaatgagtc     3000
agtgaccaat gctacactga ttaatgaact ggtgcgcaaa agcattgaag caccagtgac     3060
cccaaatact gagatagctg atgtatcctc accaactagt gactatgtca agatcctggt     3120
tgcagctgtt gctggcacca taactgtcgt tgtagttatt ttcatcactg ctgtagtaag     3180
atgtcgccag gcaccacacc ttaaggctgc tcagaaaaac atgcagaatt ctgaatgggc     3240
taccccaaac ccagaaaaca ggcagatgat aatgatgaag aaaaagaaaa agaagaagaa     3300
gcattcccct aagaacctgc tgcttaattt tgtcactatt gaagaaacta aggcagatga     3360
tgttgacagt gatggaaaca gagtcacact agaccttcct attgatctag aagagcaaac     3420
aatgggaaag tacaattggg taactacacc tactactttc aagcctgaca gccctgattt     3480
ggcccgacac tacaaatctg cctctccaca gcctgccttc caaattcagc ctgaaactcc     3540
cctgaatttg aagcaccaca tcatccaaga actgcctctc gataacacct ttgtggcctg     3600
tgactctatc tccaagtgtt cctcaagcag ttcagatccc tacagcgttt ctgactgtgg     3660
ctatccagtg acaaccttcg aggtacctgt gtccgtacac accagaccga ctgattccag     3720
gacatgaact attgaaatct gcagtgagat gtaactttct aggaacaaca aaattccatt     3780
ccccttccaa aaaatttcaa tggattgtga tttcaaaatt aggctaagat cattaatttt     3840
gtaatctaga tttcccatta taaaagcaag caaaaatcat cttaaaaatg atgtcctagt     3900
gaaccttgtg ctttctttag ctgtaatctg gcaatggaaa tttaaaattt atggaagaga     3960
cagtgcagca caataacaga gtactctcat gctgtttctc tgtttgctct gaatcaacag     4020
ccatgatgta atataaggct gtcttggtgt atacacttat ggttaatata tcagtcatga     4080
aacatgcaat tacttgccct gtctgattgt tgaataatta aaacattatc ttccaggagt     4140
ttggaagtga gctgaactag ccaaactact ctctgaaagg tatccagggc aagagacatt     4200
tttaagaccc caaacaaaca aaaaacaaaa ccaaaacact ctggttcagt gttttgaaaa     4260
tattcactaa cataatattg ctgagaaaat cattttttatt acccaccact ctgcttaaaa     4320
gttgagtggg ccgggcgcgg tggctcacgc ctgtaatccc agcactttgg gaggccgagg     4380
cgggtggatc acgaggtcag gagattgaga ccatcctggc taacacggtg aaaccccatc     4440
tccactaaaa atacaaaaaa ttagcctggc gtggtggcgg gcgcctgtag tcccagctac     4500
tcgggaggct gaggcaggag aatagcgtga acccgggagg cggagcttgc agtgagccga     4560
gatggcgcca ctctgcactc cagcctgggt gacagagcaa gactctgtct caaaaagaaa     4620
```

Figure 11c (continued)

```
aaaatgttca atgatagaaa ataattttac taggttttta tgttgattgt actcatggtg    4680
ttccactcct tttaattatt aaaaagttat ttttggggtg ggtgtggtgg ctcacaccgt    4740
aatcccagca ctttgggagg ccgaggtggg tggatcacct gaggtcagga gttcaagacc    4800
agtntggcca acatggcgaa accccgtttt aaaaaaaaaa aaaaaaaaaa aaaagaaaaa    4860
```

>109P1D4 v.7 (SEQ ID NO:130).

```
ggtggtccag tacctccaaa gatatggaat acactcctga aatatcctga aacctttttt      60
ttttcagaat cctttaataa gcagttatgt caatctgaaa gttgcttact tgtactttat     120
attaatagct attcttgttt ttcttatcca aagaaaaatc ctctaatccc cttttcacat     180
gatagttgtt accatgttta ggcgttagtc acatcaaccc ctctcctctc ccaaacttct     240
cttcttcaaa tcaaacttta ttagtccctc ctttataatg attccttgcc tccttttatc     300
cagatcaatt tttttcact ttgatgccca gagctgaaga aatggactat tgtataaatt      360
attcattgcc aagagaataa ttgcatttta aacccatgtt ataacaaaga ataatgatta     420
tatttgtga tttgtaacaa atacccttta tttcccttta actattgaat taaatatttt      480
aattatttgt attctcttta actatcttgg tatattaaag tattatcttt tatatattta     540
tcaatggtgg acactttat aggtactctg tgtcattttt gatactgtag gtatcttatt      600
tcatttatct ttattcttaa tgtacgaatt cataatattt gattcagaac agatttatca     660
ctaattaaca gagtgtcaat tatgctaaca tctcatttac tgattttaat ttaaaacagt     720
ttttgttaac atgcatgttt agggttggct tcttaataat ttcttcttcc tcttctctct     780
ctcctcttct tttggtcagt gttgtgcggg ttaatacaac aaactgtcac aagtgtttgt     840
tgtccgggac gtacattttc gcggtcctgc tagtatgcgt ggtgttccac tctggcgccc     900
aggagaaaaa ctacaccatc cgagaagaaa ttccagaaaa cgtcctgata ggcaacttgt     960
tgaaagacct taacttgtcg ctgattccaa acaagtcctt gacaactact atgcagttca    1020
agctagtgta caagaccgga gatgtgccac tgattcgaat tgaagaggat actggtgaga    1080
tcttcactac cggcgctcgc attgatcgtg agaaattatg tgctggtatc ccaagggatg    1140
agcattgctt ttatgaagtg gaggttgcca ttttgccgga tgaaatattt agactggtta    1200
agatacgttt tctgatagaa gatataaatg ataatgcacc attgttccca gcaacagtta    1260
tcaacatatc aattccagag aactcggcta taaactctaa atatactctc ccagcggctg    1320
ttgatcctga cgtaggcata aacggagttc aaaactacga actaattaag agtcaaaaca    1380
tttttggcct cgatgtcatt gaaacaccag aaggagacaa gatgccacaa ctgattgttc    1440
aaaaggagtt agatagggaa gagaaggata cctatgtgat gaaagtaaag gttgaagatg    1500
gtggctttcc tcaaagatcc agtactgcta ttttgcaagt aagtgttact gatacaaatg    1560
acaaccaccc agtctttaag gagacagaga ttgaagtcag tataccagaa aatgctcctg    1620
taggcacttc agtgacacag ctccatgcca cagatgctga cataggtgaa aatgccaaga    1680
tccacttctc tttcagcaat ctagtctcca acattgccag gagattattt cacctcaatg    1740
ccaccactgg acttatcaca atcaaagaac cactggatag ggaagaaaca ccaaaccaca    1800
agttactggt tttggcaagt gatggtggat tgatgccagc aagagcaatg gtgctggtaa    1860
atgttacaga tgtcaatgat aatgtcccat ccattgacat aagatacatc gtcaatcctg    1920
```

Figure 11c (continued)

```
tcaatgacac agttgttctt tcagaaaata ttccactcaa caccaaaatt gctctcataa    1980
ctgtgacgga taaggatgcg gaccataatg gcagggtgac atgcttcaca gatcatgaaa    2040
ttcctttcag attaaggcca gtattcagta atcagttcct cctggagaat gcagcatatc    2100
ttgactatga gtccacaaaa gaatatgcca ttaaattact ggctgcagat gctggcaaac    2160
ctcctttgaa tcagtcagca atgctcttca tcaaagtgaa agatgaaaat gacaatgctc    2220
cagttttcac ccagtctttc gtaactgttt ctattcctga gaataactct cctggcatcc    2280
agttgatgaa agtaagtgca acggatgcag acagtgggcc taatgctgag atcaattacc    2340
tgctaggccc tgatgctcca cctgaattca gcctggatcg tcgtacaggc atgctgactg    2400
tagtgaagaa actagataga gaaaaagagg ataaatattt attcacaatt ctggcaaaag    2460
ataatggggt accaccctta accagcaatg tcacagtctt tgtaagcatt attgatcaga    2520
atgacaatag cccagttttc actcacaatg aatacaaatt ctatgtccca gaaaaccttc    2580
caaggcatgg tacagtagga ctaatcactg taactgatcc tgattatgga gacaattctg    2640
cagttacgct ctccatttta gatgagaatg atgacttcac cattgattca caaactggtg    2700
tcatccgacc aaatatttca tttgatagag aaaaacaaga atcttacact ttctatgtaa    2760
aggctgagga tggtggtaga gtatcacgtt cttcaagtgc caaagtaacc ataaatgtgg    2820
ttgatgtcaa tgacaacaaa ccagttttca ttgtccctcc ttacaactat tcttatgaat    2880
tggttctacc gtccactaat ccaggcacag tggtctttca ggtaattgct gttgacaatg    2940
acactggcat gaatgcagag gttcgttaca gcattgtagg aggaaacaca agagatctgt    3000
ttgcaatcga ccaagaaaca ggcaacataa cattgatgga gaaatgtgat gttacagacc    3060
ttggtttaca cagagtgttg gtcaaagcta atgacttagg acagcctgat tctctcttca    3120
gtgttgtaat tgtcaatctg ttcgtgaatg agtcagtgac caatgctaca ctgattaatg    3180
aactggtgcg caaaagcatt gaagcaccag tgaccccaaa tactgagata gctgatgtat    3240
cctcaccaac tagtgactat gtcaagatcc tggttgcagc tgttgctggc accataactg    3300
tcgttgtagt tattttcatc actgctgtag taagatgtcg ccaggcacca caccttaagg    3360
ctgctcagaa aaacatgcag aattctgaat gggctacccc aaacccagaa aacaggcaga    3420
tgataatgat gaagaaaaag aaaaagaaga agaagcattc ccctaagaac ctgctgctta    3480
atgttgtcac tattgaagaa actaaggcag atgatgttga cagtgatgga aacagagtca    3540
cactagacct tcctattgat ctagaagagc aaacaatggg aaagtacaat tgggtaacta    3600
cacctactac tttcaagcct gacagccctg atttggcccg acactacaaa tctgcctctc    3660
cacagcctgc cttccaaatt cagcctgaaa ctcccctgaa tttgaagcac cacatcatcc    3720
aagaactgcc tctcgataac acctttgtgg cctgtgactc tatctccaat tgttcctcaa    3780
gcagttcaga tccctacagc gtttctgact gtggctatcc agtgacaacc ttcgaggtac    3840
ctgtgtccgt acacaccaga ccgactgatt ccaggacatg aactattgaa atctgcagtg    3900
agatgtaact ttctaggaac aacaaaattc cattcccctt ccaaaaaatt tcaatgattg    3960
tgatttcaaa attaggctaa gatcattaat tttgtaatct agatttccca ttataaaagc    4020
aagcaaaaat catcttaaaa atgatgtcct agtgaacctt gtgctttctt tagctgtaat    4080
ctggcaatgg aaatttaaaa tttatggaag agacagtgca gcgcaataac agagtactct    4140
catgctgttt ctctgtttgc tctgaatcaa cagccatgat gtaatataag gctgtcttgg    4200
tgtatacact tatggttaat                                                4220
```

Figure 11c (continued)

>109P1D4 v.8 (SEQ ID NO:131).

```
ggtggtccag tacctccaaa gatatggaat acactcctga aatatcctga aacctttttt      60
ttttcagaat cctttaataa gcagttatgt caatctgaaa gttgcttact tgtactttat     120
attaatagct attcttgttt ttcttatcca aagaaaaatc ctctaatccc cttttcacat     180
gatagttgtt accatgttta ggcgttagtc acatcaaccc ctctcctctc ccaaacttct     240
cttcttcaaa tcaaacttta ttagtccctc ctttataatg attccttgcc tcctttttatc     300
cagatcaatt tttttcact ttgatgccca gagctgaaga aatggactat tgtataaatt     360
attcattgcc aagagaataa ttgcatttta aacccatgtt ataacaaaga ataatgatta     420
tattttgtga tttgtaacaa ataccettta ttttccctta actattgaat taaatatttt     480
aattatttgt attctcttta actatcttgg tatattaaag tattatcttt tatatattta     540
tcaatggtgg acacttttat aggtactctg tgtcattttt gatactgtag gtatcttatt     600
tcatttatct ttattcttaa tgtacgaatt cataatattt gattcagaac agatttatca     660
ctaattaaca gagtgtcaat tatgctaaca tctcatttac tgattttaat ttaaaacagt     720
ttttgttaac atgcatgttt agggttggct tcttaataat ttcttcttcc tcttctctct     780
ctcctcttct tttggtcagt gttgtgcggg ttaatacaac aaactgtcac aagtgtttgt     840
tgtccgggac gtacattttc gcggtcctgc tagtatgcgt ggtgttccac tctggcgccc     900
aggagaaaaa ctacaccatc cgagaagaaa ttccagaaaa cgtcctgata ggcaacttgt     960
tgaaagacct taacttgtcg ctgattccaa acaagtcctt gacaactact atgcagttca    1020
agctagtgta caagaccgga gatgtgccac tgattcgaat tgaagaggat actggtgaga    1080
tcttcactac cggcgctcgc attgatcgtg agaaattatg tgctggtatc ccaagggatg    1140
agcattgctt ttatgaagtg gaggttgcca ttttgccgga tgaaatattt agactggtta    1200
agatacgttt tctgatagaa gatataaatg ataatgcacc attgttccca gcaacagtta    1260
tcaacatatc aattccagag aactcggcta taaactctaa atatactctc ccagcggctg    1320
ttgatcctga cgtaggcata aacggagttc aaaactacga actaattaag agtcaaaaca    1380
tttttggcct cgatgtcatt gaaacaccag aaggagacaa gatgccacaa ctgattgttc    1440
aaaaggagtt agatagggaa gagaaggata cctatgtgat gaaagtaaag gttgaagatg    1500
gtggctttcc tcaaagatcc agtactgcta ttttgcaagt aagtgttact gatacaaatg    1560
acaaccaccc agtctttaag gagacagaga ttgaagtcag tataccagaa aatgctcctg    1620
taggcacttc agtgacacag ctccatgcca cagatgctga cataggtgaa aatgccaaga    1680
tccacttctc tttcagcaat ctagtctcca acattgccag gagattattt cacctcaatg    1740
ccaccactgg acttatcaca atcaaagaac cactggatag ggaagaaaca ccaaaccaca    1800
agttactggt tttggcaagt gatggtggat tgatgccagc aagagcaatg gtgctggtaa    1860
atgttacaga tgtcaatgat aatgtcccat ccattgacat aagatacatc gtcaatcctg    1920
tcaatgacac agttgttctt tcagaaaata ttccactcaa caccaaaatt gctctcataa    1980
ctgtgacgga taaggatgcg gaccataatg gcagggtgac atgcttcaca gatcatgaaa    2040
ttcctttcag attaaggcca gtattcagta atcagttcct cctggagaat gcagcatatc    2100
ttgactatga gtccacaaaa gaatatgcca ttaaattact ggctgcagat gctggcaaac    2160
ctcctttgaa tcagtcagca atgctcttca tcaaagtgaa agatgaaaat gacaatgctc    2220
cagttttcac ccagtctttc gtaactgttt ctattcctga gaataactct cctggcatcc    2280
```

Figure 11c (continued)

```
agttgatgaa agtaagtgca acggatgcag acagtgggcc taatgctgag atcaattacc    2340
tgctaggccc tgatgctcca cctgaattca gcctggatcg tcgtacaggc atgctgactg    2400
tagtgaagaa actagataga gaaaaagagg ataaatattt attcacaatt ctggcaaaag    2460
ataatggggt accaccctta accagcaatg tcacagtctt tgtaagcatt attgatcaga    2520
atgacaatag cccagttttc actcacaatg aatacaaatt ctatgtccca gaaaaccttc    2580
caaggcatgg tacagtagga ctaatcactg taactgatcc tgattatgga gacaattctg    2640
cagttacgct ctccatttta gatgagaatg atgacttcac cattgattca caaactggtg    2700
tcatccgacc aaatatttca tttgatagag aaaaacaaga atcttacact ttctatgtaa    2760
aggctgagga tggtggtaga gtatcacgtt cttcaagtgc caaagtaacc ataaatgtgg    2820
ttgatgtcaa tgacaacaaa ccagttttca ttgtccctcc ttacaactat tcttatgaat    2880
tggttctacc gtccactaat ccaggcacag tggtctttca ggtaattgct gttgacaatg    2940
acactggcat gaatgcagag gttcgttaca gcattgtagg aggaaacaca agagatctgt    3000
ttgcaatcga ccaagaaaca ggcaacataa cattgatgga gaaatgtgat gttacagacc    3060
ttggtttaca cagagtgttg gtcaaagcta atgacttagg acagcctgat tctctcttca    3120
gtgttgtaat tgtcaatctg ttcgtgaatg agtcagtgac caatgctaca ctgattaatg    3180
aactggtgcg caaaagcatt gaagcaccag tgaccccaaa tactgagata gctgatgtat    3240
cctcaccaac tagtgactat gtcaagatcc tggttgcagc tgttgctggc accataactg    3300
tcgttgtagt tattttcatc actgctgtag taagatgtcg ccaggcacca caccttaagg    3360
ctgctcagaa aaacatgcag aattctgaat gggctacccc aaacccagaa aacaggcaga    3420
tgataatgat gaagaaaaag aaaaagaaga agaagcattc ccctaagaac ctgctgctta    3480
atgttgtcac tattgaagaa actaaggcag atgatgttga cagtgatgga aacagagtca    3540
cactagacct tcctattgat ctagaagagc aaacaatggg aaagtacaat tgggtaacta    3600
cacctactac tttcaagcct gacagccctg atttggcccg acactacaaa tctgcctctc    3660
cacagcctgc cttccaaatt cagcctgaaa ctcccctgaa tttgaagcac cacatcatcc    3720
aagaactgcc tctcgataac acctttgtgg cctgtgactc tatctccaat tgttcctcaa    3780
gcagttcaga tccctacagc gtttctgact gtggctatcc agtgacaacc ttcgaggtac    3840
ctgtgtccgt acacaccaga ccgtcccagc ggcgtgtcac atttcacctg ccagaaggct    3900
ctcaggaaag cagcagtgat ggtggactgg gagaccatga tgcaggcagc cttaccagca    3960
catcccatgg cctgcccctt ggctatcctc aggaggagta ctttgatcgt gctacaccca    4020
gcaatcgcac tgaaggggat ggcaactccg atcctgaatc tactttcata cctggactaa    4080
agaaagaaat aactgttcaa ccaactgtgg aagaggcctc tgacaactgc actcaagaat    4140
gtctcatcta tggccattct gatgcctgct ggatgccggc atctctggat cattccagct    4200
cttcacaagc acaggcctct gctctatgcc acagcccacc actgtcacag gcctctactc    4260
agcaccacag cccaccagtg acacagacca ttgttctctg ccacagccct ccagtgacac    4320
agaccatcgc attgtgccac agcccaccac cgatacaggt gtctgctctc caccacagtc    4380
ctccctctagt gcagggtact gcacttcacc acagcccacc atcagcacag gcctcagccc    4440
tctgctacag ccctccttta gcacaggctg ctgcaatcag ccacagctct tctctgccac    4500
aggttattgc cctccatcgt agtcaggccc aatcatcagt cagtttgcag caaggttggg    4560
tgcaaggtgc taatggacta tgctctgttg atcagggagt gcaaggtagt gcaacatctc    4620
```

Figure 11c (continued)

```
agttttacac catgtctgaa agacttcatc ccagtgatga ttcaattaaa gtcattcctt    4680
tgacaacctt cgctccacgc caacaggcca gaccgtccag aggtgattcc cccattatgg    4740
aaacacatcc cttgtaaagc taaaatagtt acttcaaatt ttcagaaaag atgtatatag    4800
tcaaaattta agatacaatt ccaatgagta ttctgattat cagatttgta aataactatg    4860
taaatagaaa cagataccag aataaatcta cagctagacc cttagtcaat agttaaccaa    4920
aaaattgcaa tttgtttaat tcagaatgtg tatttaaaaa gaaaaggaat ttaacaattt    4980
gcatcccctt gtacagtaag gcttatcatg acagagcgta ctatttctga tgtacagtat    5040
tttttgttgt ttttatcatc atgtgcaata ttactgattt gtttccatgc tgattgtgtg    5100
gaaccagtat gtagcaaatg gaaagcctag aaatatctta ttttctaagt ttacctttag    5160
tttacctaaa cttttgttca gataatgtta aaaggtatac gtactctagc ctttttttggg    5220
gctttctttt tgatttttgt ttgtggtttt cagttttttt gttgttgtta gtgagtctcc    5280
cttcaaaata cacagtaggt agtgtaaata ctgcttgttt gtgtctctct gctgtcatgt    5340
tttctacctt attccaatac tatattgttg ataaaatttg tatatacatt ttcaataaag    5400
aatatgtata aactgtacag atctagatct acaacctatt tctctactct ttagtagagt    5460
tcgagacaca gaagtgcaat aactgcccta attaagcaac tatttgttaa aaagggcccc    5520
tttttacttt aatagtttag tgtaaagtac atcagaaata aaactgtatc tgacatttta    5580
agcctgtagt ccattattac ttgggtcttt acttctggga atttgtatgt aacagcctag    5640
aaaattaaaa ggaggtggat gcatccaaag cacgagtcac ttaaaatatc gacggtaaac    5700
tactattttg tagagaaact caggaagatt taaatgttga tttgacagct caataggctg    5760
ttaccaaagg gtgttcagta aaaataacaa atacatgtaa ctgtagataa aaccacatac    5820
taaatctata agactaaggg atttttgtta ttctagctca acttactgaa gaaaaccact    5880
aataacaaca agaatatcag gaaggaactt ttcaagaaat gtaattataa atctacatca    5940
aacagaattt taaggaaaaa tgcagaggga gaaataaggc acatgactgc ttcttgcagt    6000
caagaagaaa taccaataac acacacagaa caaaaaccat caaaatctca tatatgaaat    6060
aaaatatatt cttctaagca aagaaacagt actattcata gaaaacatta gtttttctcct    6120
gttgtctgtt atttccttct tttatcctct taactggcca ttatcttgta tgtgcacatt    6180
ttataaatgt acagaaacat caccaacttg atttcttcc atagcaaaac tgagaaaata    6240
ccttgtttca gtataacact aaaccaagag acaattgatg tttaatgggg gcggttgggg    6300
ttggggggga gtcaatatct cctattgatt aacttagaca tagattttgt aatgtataac    6360
ttgatattta atttatgatt aaactgtaat tttgtaacat aaactgtggt aattgcataa    6420
tttcattggt gaggatttcc tttgaatatt gagaaagttt cttttcatgt gcccagcagg    6480
ttaagtagcg ttttcagaat atacattatt cccatccatt gtaaagttcc ttaagtcata    6540
tttgactggg cgtgcagaat aacttcttaa ctattaacta tcagagtttg attaataaaa    6600
ttaattaatt ttttttctcc ttcgtgttgt taatgttcca agggatttgg agcatactgg    6660
ttttccaggt gcatgtgaat cccgaaggac tgatgatatt tgaatgttta ttaaattatt    6720
atcacacaaa tgtgttgata ttgtggctat tgttgatgtt gaaaattgta aacttgggga    6780
agattaagaa aagaaccaat agtgacaaaa atcagtgctt ccagtagatt ttagaacatt    6840
ctttgcctca aaaaacctgc aaagatgatg tgagattttt tcttgtgttt taattatttt    6900
cacattttct ctctgcaaac ctttagtttt ctgatgatct acacacacac atacacacac    6960
```

Figure 11c (continued)

```
acacacacac acgtgcacac acacacattt aaaggatata aaaagaagag gttgaaagat    7020
tattaaataa cttatcaggc atctcaatgg ttactatcta tgttagtgaa aatcaaatag    7080
gactcaaagt tggatatttg ggatttttct tctgacagta taatttattg agttactagg    7140
gaggttctta aatcctcata tctggaaact tgtgaagttt tgacaccttt cctatagata    7200
taggaatgaa ccaatacgct tttattaccc tttctaactc tgattttata atcagactta    7260
gattgtgttt agaatattaa atgactgggc accctcttct tggtttttac cagagaggct    7320
ttgaatggaa gcaggctgag agtagccaaa gaggcaaggg gtattagccc agttattctc    7380
ccctatgcct tctcttccta agcgtccact aggtctggcc ttggaaatct gttacttcta    7440
cggcttcaga tctgatgata tctttttcat cacattacaa gttatttctt tgactgaata    7500
gacagtggta taggttgaca cagcacacaa gtggctattg tgatgtatga tgtatgtagt    7560
cccacaactg caaaacgtct tactgaagca acaatcgaaa aatggttctg ttttaaaaag    7620
gattttgttt gatttgaaat taaaacttca aactgaatga cttatatgag aataatatgt    7680
tcaatcaaag tagttattct attttgtgtc catattccat tagattgtga ttattaattt    7740
tctagctatg gtattactat atcacacttg tgagtatgta ttcaaatact aagtatctta    7800
tatgctacgt gcatacacat tcttttctta aactttacct gtgttttaac taatattgtg    7860
tcagtgtatt aaaaattagc ttttacatat gatatctaca atgtaataaa tttagagagt    7920
aattttgtgt attcttattt acttaacatt ttacttttaa ttatgtaaat ttggttagaa    7980
aataataata aatggttagt gctattgtgt aatggtagca gttacaaaga gcctctgcct    8040
tcccaaacta atatttatca cacatggtca ttaaatggga aaaaaataga ctaaacaaat    8100
cacaaattgt tcagttctta aaatgtaatt atgtcacaca cacaaaaaaa tccttttcaa    8160
tcctgagaaa attaaaggtg ttttactcac atggatattt caacattagt tttttttgtt    8220
tgtttctttt tcatggtatt actgaaggtg tgtatactcc ctaatacaca tttatgaaaa    8280
tctacttgtt tagactttta tttatactct tctgatttat atttttttatt ataattatta    8340
tttcttatct tcttttatat tttttggaaa ccaaatttat agttagttta ggtaaacttt    8400
ttattatgac cattagaaac tattttgaat gtttccaact ggctcaattg gctgggaaaa    8460
catgggaaca agagaagctg aaatatattt ctgcaagaac ctttctatat tatgtgccaa    8520
ttaccacacc agatcaattt tatgcagagg ccttaaaata ttctttcaca gtagctttct    8580
tacactaacc gtcatgtgct tttagtaaat atgattttta aaagcagttc aagttgacaa    8640
cagcagaaac agtaacaaaa aaatctgctc agaaaaatgt atgtgcacaa ataaaaaaaa    8700
ttaatggcaa ttgtttagtg actgtaagtg atactttta aagagtaaac tgtgtgaaat    8760
ttatactatc cctgcttaaa atattaagat ttttatgaaa tatgtattta tgtttgtatt    8820
gtgggaagat tcctcctctg tgatatcata cagcatctga aagtgaacag tatcccaaag    8880
cagttccaag catgctttgg aagtaagaag gttgactatt gtatggccaa ggatggcagt    8940
atgtaatcca gaagcaaact tgtattaatt gttctatttc aggttct                  8987
```

Figure 12c Protein sequences of transcript variants of 109P1D4

>109P1D4 v.2 (SEQ ID NO:132).

```
MDLLSGTYIF AVLLACVVFH SGAQEKNYTI REEMPENVLI GDLLKDLNLS LIPNKSLTTA      60
MQFKLVYKTG DVPLIRIEED TGEIFTTGAR IDREKLCAGI PRDEHCFYEV EVAILPDEIF     120
RLVKIRFLIE DINDNAPLFP ATVINISIPE NSAINSKYTL PAAVDPDVGI NGVQNYELIK     180
SQNIFGLDVI ETPEGDKMPQ LIVQKELDRE EKDTYVMKVK VEDGGFPQRS STAILQVSVT     240
DTNDNHPVFK ETEIEVSIPE NAPVGTSVTQ LHATDADIGE NAKIHFSFSN LVSNIARRLF     300
HLNATTGLIT IKEPLDREET PNHKLLVLAS DGGLMPARAM VLVNVTDVND NVPSIDIRYI     360
VNPVNDTVVL SENIPLNTKI ALITVTDKDA DHNGRVTCFT DHEIPFRLRP VFSNQFLLET     420
AAYLDYESTK EYAIKLLAAD AGKPPLNQSA MLFIKVKDEN DNAPVFTQSF VTVSIPENNS     480
PGIQLTKVSA MDADSGPNAK INYLLGPDAP PEFSLDCRTG MLTVVKKLDR EKEDKYLFTI     540
LAKDNGVPPL TSNVTVFVSI IDQNDNSPVF THNEYNFYVP ENLPRHGTVG LITVTDPDYG     600
DNSAVTLSIL DENDDFTIDS QTGVIRPNIS FDREKQESYT FYVKAEDGGR VSRSSSAKVT     560
INVVDVNDNK PVFIVPPSNC SYELVLPSTN PGTVVFQVIA VDNDTGMNAE VRYSIVGGNT     720
RDLFAIDQET GNITLMEKCD VTDLGLHRVL VKANDLGQPD SLFSVVIVNL FVNESVTNAT     780
LINELVRKST EAPVTPNTEI ADVSSPTSDY VKILVAAVAG TITVVVVIFI TAVVRCRQAP     840
HLKAAQKNKQ NSEWATPNPE NRQMIMMKKK KKKKKHSPKN LLLNFVTIEE TKADDVDSDG     900
NRVTLDLPID LEEQTMGKYN WVTTPTTFKP DSPDLARHYK SASPQPAFQI QPETPLNSKH     960
HIIQELPLDN TFVACDSISK CSSSSSDPYS VSDCGYPVTT FEVPVSVHTR PTDSRTSTIE    1020
ICSEI                                                                1025
```

>109P1D4 v.3 (SEQ ID NO:133).

```
MDLLSGTYIF AVLLACVVFH SGAQEKNYTI REEMPENVLI GDLLKDLNLS LIPNKSLTTA      60
MQFKLVYKTG DVPLIRIEED TGEIFTTGAR IDREKLCAGI PRDEHCFYEV EVAILPDEIF     120
RLVKIRFLIE DINDNAPLFP ATVINISIPE NSAINSKYTL PAAVDPDVGI NGVQNYELIK     180
SQNIFGLDVI ETPEGDKMPQ LIVQKELDRE EKDTYVMKVK VEDGGFPQRS STAILQVSVT     240
DTNDNHPVFK ETEIEVSIPE NAPVGTSVTQ LHATDADIGE NAKIHFSFSN LVSNIARRLF     300
HLNATTGLIT IKEPLDREET PNHKLLVLAS DGGLMPARAM VLVNVTDVND NVPSIDIRYI     360
VNPVNDTVVL SENIPLNTKI ALITVTDKDA DHNGRVTCFT DHEIPFRLRP VFSNQFLLET     420
AAYLDYESTK EYAIKLLAAD AGKPPLNQSA MLFIKVKDEN DNAPVFTQSF VTVSIPENNS     480
PGIQLTKVSA MDADSGPNAK INYLLGPDAP PEFSLDCRTG MLTVVKKLDR EKEDKYLFTI     540
LAKDNGVPPL TSNVTVFVSI IDQNDNSPVF THNEYNFYVP ENLPRHGTVG LITVTDPDYG     600
DNSAVTLSIL DENDDFTIDS QTGVIRPNIS FDREKQESYT FYVKAEDGGR VSRSSSAKVT     660
INVVDVNDNK PVFIVPPSNC SYELVLPSTN PGTVVFQVIA VDNDTGMNAE VRYSIVGGNT     720
RDLFAIDQET GNITLMEKCD VTDLGLHRVL VKANDLGQPD SLFSVVIVNL FVNESVTNAT     780
LINELVRKST EAPVTPNTEI ADVSSPTSDY VKILVAAVAG TITVVVVIFI TAVVRCRQAP     840
HLKAAQKNKQ NSEWATPNPE NRQMIMMKKK KKKKKHSPKN LLLNFVTIEE TKADDVDSDG     900
NRVTLDLPID LEEQTMGKYN WVTTPTTFKP DSPDLARHYK SASPQPAFQI QPETPLNSKH     960
HIIQELPLDN TFVACDSISK CSSSSSDPYS VSDCGYPVTT FEVPVSVHTR PPMKEVVRSC    1020
```

Figure 12c (continued)

```
TPMKESTIME IWIHPQPQRK SEGKVAGKSQ RRVTFHLPEG SQESSSDGGL GDHDAGSLTS    1080
TSHGLPLGYP QEEYFDRATP SNRTEGDGNS DPESTFIPGL KKAAEITVQP TVEEASDNCT    1140
QECLIYGHSD ACWMPASLDH SSSSQAQASA LCHSPPLSQA STQHHSPRVT QTIALCHSPP    1200
VTQTIALCHS PPPIQVSALH HSPPLVQATA LHHSPPSAQA SALCYSPPLA QAAAISHSSP    1260
LPQVIALHRS QAQSSVSLQQ GWVQGADGLC SVDQGVQGSA TSQFYTMSER LHPSDDSIKV    1320
IPLTTFTPRQ QARPSRGDSP IMEEHPL                                        1347
```

>109P1D4 v.4 (SEQ ID NO:134).

```
MDLLSGTYIF AVLLACVVFH SGAQEKNYTI REEMPENVLI GDLLKDLNLS LIPNKSLTTA      60
MQFKLVYKTG DVPLIRIEED TGEIFTTGAR IDREKLCAGI PRDEHCFYEV EVAILPDEIF     120
RLVKIRFLIE DINDNAPLFP ATVINISIPE NSAINSKYTL PAAVDPDVGI NGVQNYELIK     180
SQNIFGLDVI ETPEGDKMPQ LIVQKELDRE EKDTYVMKVK VEDGGFPQRS STAILQVSVT     240
DTNDNHPVFK ETEIEVSIPE NAPVGTSVTQ LHATDADIGE NAKIHFSFSN LVSNIARRLF     300
HLNATTGLIT IKEPLDREET PNHKLLVLAS DGGLMPARAM VLVNVTDVND NVPSIDIRYI     360
VNPVNDTVVL SENIPLNTKI ALITVTDKDA DHNGRVTCFT DHEIPFRLRP VFSNQFLLET     420
AAYLDYESTK EYAIKLLAAD AGKPPLNQSA MLFIKVKDEN DNAPVFTQSF VTVSIPENNS     480
PGIQLTKVSA MDADSGPNAK INYLLGPDAP PEFSLDCRTG MLTVVKKLDR EKEDKYLFTI     540
LAKDNGVPPL TSNVTVFVSI IDQNDNSPVF THNEYNFYVP ENLPRHGTVG LITVTDPDYG     600
DNSAVTLSIL DENDDFTIDS QTGVIRPNIS FDREKQESYT FYVKAEDGGR VSRSSSAKVT     660
INVVDVNDNK PVFIVPPSNC SYELVLPSTN PGTVVFQVIA VDNDTGMNAE VRYSIVGGNT     720
RDLFAIDQET GNITLMEKCD VTDLGLHRVL VKANDLGQPD SLFSVVIVNL FVNESVTNAT     780
LINELVRKST EAPVTPNTEI ADVSSPTSDY VKILVAAVAG TITVVVVIFI TAVVRCRQAP     840
HLKAAQKNKQ NSEWATPNPE NRQMIMMKKK KKKKKHSPKN LLLNFVTIEE TKADDVDSDG     900
NRVTLDLPID LEEQTMGKYN WVTTPTTFKP DSPDLARHYK SASPQPAFQI QPETPLNSKH     960
HIIQELPLDN TFVACDSISK CSSSSSDPYS VSDCGYPVTT FEVPVSVHTR PPMKEVVRSC    1020
TPMKESTTME IWIHPQPQSQ RRVTFHLPEG SQESSSDGGL GDHDAGSLTS TSHGLPLGYP    1080
QEEYFDRATP SNRTEGDGNS DPESTFIPGL KKAAEITVQP TVEEASDNCT QECLIYGHSD    1140
ACWMPASLDH SSSSQAQASA LCHSPPLSQA STQHHSPRVT QTIALCHSPP VTQTIALCHS    1200
PPPIQVSALH HSPPLVQATA LHHSPPSAQA SALCYSPPLA QAAAISHSSP LPQVIALHRS    1260
QAQSSVSLQQ GWVQGADGLC SVDQGVQGSA TSQFYTMSER LHPSDDSIKV IPLTTFTPRQ    1320
QARPSRGDSP IMEEHPL                                                   1337
```

>109P1D4 v.5 (SEQ ID NO:135).

```
MDLLSGTYIF AVLLACVVFH SGAQEKNYTI REEMPENVLI GDLLKDLNLS LIPNKSLTTA      60
MQFKLVYKTG DVPLIRIEED TGEIFTTGAR IDREKLCAGI PRDEHCFYEV EVAILPDEIF     120
RLVKIRFLIE DINDNAPLFP ATVINISIPE NSAINSKYTL PAAVDPDVGI NGVQNYELIK     180
SQNIFGLDVI ETPEGDKMPQ LIVQKELDRE EKDTYVMKVK VEDGGFPQRS STAILQVSVT     240
```

Figure 12c (continued)

```
DPNANHPVFK EPEIEVSIPE NAPVGTSVTQ LHATDADIGE NAKIHFSFSN LVSNIARRLF    300
HLNATTGLIT IKEPLDREET PNHKLLVLAS DGGLMPARAM VLVNVTDVND NVPSIDIRYI    360
VNPVNDTVVL SENIPLNTKI ALITVTDKDA DHNGRVTCFT DHEIPFRLRP VFSNQFLLET    420
AAYLDYESTK EYAIKLLAAD AGKPPLNQSA MLFIKVKDEN DNAPVFTQSF VTVSIPENNS    480
PGIQLTKVSA MDADSGPNAK INYLLGPDAP PEFSLDCRTG MLTVVKKLDR EKEDKYLFTI    540
LAKDNGVPPL TSNVTVFVSI IDQNDNSPVF THNEYNFYVP ENLPRHGTVG LITVTDPDYG    600
DNSAVTLSIL DENDDFTIDS QTGVIRPNIS FDREKQESYT FYVKAEDGGR VSRSSSAKVT    660
INVVDVNDNK PVFIVPPSNC SYELVLPSTN PGTVVFQVIA VDNDTGMNAE VRYSIVGGNI    720
RDLFAIDQET GNITLMEKCD VTDLGLHRVL VKANDLGQPD SLFSVVIVNL FVNESVTNAT    780
LINELVRKST EAPVTPNTEI ADVSSPTSDY VKILVAAVAG TITVVVVIFI TAVVRCRQAP    840
HLKAAQKNKQ NSEWATPNPE NRQMIMMKKK KKKKKHSPKN LLLNFVTIEE TKADDVDSDG    900
NRVTLDLPID LEEQTMGKYN WVTTPTTFKP DSPDLARHYK SASPQPAFQI QPETPLNSKH    960
HIIQELPLDN TFVACDSISK CSSSSSDPYS VSDCGYPVTT FEVPVSVHTR PSQRRVTFHL   1020
PEGSQESSSD GGLGDHDAGS LTSTSHGLPL GYPQEEYFDR ATPSNRTEGD GNSDPESTFI   1080
PGLKKAAEIT VQPTVEEASD NCTQECLIYG HSDACWMPAS LDHSSSSQAQ ASALCHSPPL   1140
SQASTQHHSP RVTQTIALCH SPPVTQTIAL CHSPPPIQVS ALHHSPPLVQ ATALHHSPPS   1200
AQASALCYSP PLAQAAAISH SSPLPQVIAL HRSQAQSSVS LQQGWVQGAD GLCSVDQGVQ   1260
GSATSQFYTM SERLHPSDDS IKVIPLTTFT PRQQARPSRG DSPIMEEHPL              1310
```

>109P1D4 v.6 (SEQ ID NO:136).

```
MTVGFNSDIS SVVRVNTTNC HKCLLSGTYI FAVLLVCVVF HSGAQEKNYT IREEIPENVL     60
IGNLLKDLNL SLIPNKSLTT TMQFKLVYKT GDVPLIRIEE DTGEIFTTGA RIDREKLCAG    120
IPRDEHCFYE VEVAILPDEI FRLVKIRFLI EDINDNAPLF PATVINISIP ENSAINSKYT    180
LPAAVDPDVG INGVQNYELI KSQNIFGLDV IETPEGDKMP QLIVQKELDR EEKDTYVMKV    240
KVEDGGFPQR SSTAILQVSV TDTNDNHPVF KETEIEVSIP ENAPVGTSVT QLHATDADIG    300
ENAKIHFSFS NLVSNIARRL FHLNATTGLI TIKEPLDREE TPNHKLLVLA SDGGLMPARA    360
MVLVNVTDVN DNVPSIDIRY IVNPVNDTVV LSENIPLNTK IALITVTDKD ADHNGRVTCF    420
TDHEIPFRLR PVFSNQFLLE NAAYLDYEST KEYAIKLLAA DAGKPPLNQS AMLFIKVKDE    480
NDNAPVFTQS FVTVSIPENN SPGIQLMKVS ATDADSGPNA EINYLLGPDA PPEFSLDRRT    540
GMLTVVKKLD REKEDKYLFT ILAKDNGVPP LTSNVTVFVS IIDQNDNSPV FTHNEYKFYV    600
PENLPRHGTV GLITVTDPDY GDNSAVTLSI LDENDDFTID SQTGVIRPNI SFDREKQESY    660
TFYVKAEDGG RVSRSSSAKV TINVVDVNDN KPVFIVPPYN YSYELVLPST NPGTVVFQVI    720
AVDNDTGMNA EVRYSIVGGN TRDLFAIDQE TGNITLMEKC DVTDLGLHRV LVKANDLGQP    780
DSLFSVVIVN LFVNESVTNA TLINELVRKS IEAPVTPNTE IADVSSPTSD YVKILVAAVA    840
GTITVVVVIF ITAVVRCRQA PHLKAAQKNM QNSEWATPNP ENRQMIMMKK KKKKKKHSPK    900
NLLLNFVTIE ETKADDVDSD GNRVTLDLPI DLEEQTMGKY NWVTTPTTFK PDSPDLARHY    960
KSASPQPAFQ IQPETPLNLK HHIIQELPLD NTFVACDSIS KCSSSSSDPY SVSDCGYPVT   1020
TFEVPVSVHT RPTDSRT                                                  1037
```

Figure 12c (continued)

>109P1D4 v.7 (SEQ ID NO:137)

```
MFRVGFLIIS SSSSLSPLLL VSVVRVNTTN CHKCLLSGTY IFAVLLVCVV FHSGAQEKNY      60
TIREEIPENV LIGNLLKDLN LSLIPNKSLT TTMQFKLVYK TGDVPLIRIE EDTGEIFTTG     120
ARIDREKLCA GIPRDEHCFY EVEVAILPDE IFRLVKIRFL IEDINDNAPL FPATVINISI     180
PENSAINSKY TLPAAVDPDV GINGVQNYEL IKSQNIFGLD VIETPEGDKM PQLIVQKELD     240
REEKDTYVMK VKVEDGGFPQ RSSTAILQVS VTDTNDNHPV FKETEIEVSI PENAPVGTSV     300
TQLHATDADI GENAKIHFSF SNLVSNIARR LFHLNATTGL ITIKEPLDRE ETPNHKLLVL     360
ASDGGLMPAR AMVLVNVTDV NDNVPSIDIR YIVNPVNDTV VLSENIPLNT KIALITVTDK     420
DADHNGRVTC FTDHEIPFRL RPVFSNQFLL ENAAYLDYES TKEYAIKLLA ADAGKPPLNQ     480
SAMLFIKVKD ENDNAPVFTQ SFVTVSIPEN NSPGIQLMKV SATDADSGPN AEINYLLGPD     540
APPEFSLDRR TGMLTVVKKL DREKEDKYLF TILAKDNGVP PLTSNVTVFV SIIDQNDNSP     600
VFTHNEYKFY VPENLPRHGT VGLITVTDPD YGDNSAVTLS ILDENDDFTI DSQTGVIRPN     660
ISFDREKQES YTFYKAEDG GRVSRSSSAK VTINVVDVND NKPVFIVPPY NYSYELVLPS     720
TNPGTVVFQV IAVDNDTGMN AEVRYSIVGG NTRDLFAIDQ ETGNITLMEK CDVTDLGLHR     780
VLVKANDLGQ PDSLFSVVIV NLFVNESVTN ATLINELVRK SIEAPVTPNT EIADVSSPTS     840
DYVKILVAAV AGTITVVVVI FITAVVRCRQ APHLKAAQKN MQNSEWATPN PENRQMIMMK     900
KKKKKKKHSP KNLLLNVVTI EETKADDVDS DGNRVTLDLP IDLEEQTMGK YNWVTTPTTF     960
KPDSPDLARH YKSASPQPAF QIQPETPLNL KHHIIQELPL DNTFVACDSI SNCSSSSSDP    1020
YSVSDCGYPV TTFEVPVSVH TRPTDSRT                                      1048
```

>109P1D4 v.8 (SEQ ID NO:138).

```
MFRVGFLIIS SSSSLSPLLL VSVVRVNTTN CHKCLLSGTY IFAVLLVCVV FHSGAQEKNY      60
TIREEIPENV LIGNLLKDLN LSLIPNKSLT TTMQFKLVYK TGDVPLIRIE EDTGEIFTTG     120
ARIDREKLCA GIPRDEHCFY EVEVAILPDE IFRLVKIRFL IEDINDNAPL FPATVINISI     180
PENSAINSKY TLPAAVDPDV GINGVQNYEL IKSQNIFGLD VIETPEGDKM PQLIVQKELD     240
REEKDTYVMK VKVEDGGFPQ RSSTAILQVS VTDTNDNHPV FKETEIEVSI PENAPVGTSV     300
TQLHATDADI GENAKIHFSF SNLVSNIARR LFHLNATTGL ITIKEPLDRE ETPNHKLLVL     360
ASDGGLMPAR AMVLVNVTDV NDNVPSIDIR YIVNPVNDTV VLSENIPLNT KIALITVTDK     420
DADHNGRVTC FTDHEIPFRL RPVFSNQFLL ENAAYLDYES TKEYAIKLLA ADAGKPPLNQ     480
SAMLFIKVKD ENDNAPVFTQ SFVTVSIPEN NSPGIQLMKV SATDADSGPN AEINYLLGPD     540
APPEFSLDRR TGMLTVVKKL DREKEDKYLF TILAKDNGVP PLTSNVTVFV SIIDQNDNSP     600
VFTHNEYKFY VPENLPRHGT VGLITVTDPD YGDNSAVTLS ILDENDDFTI DSQTGVIRPN     660
ISFDREKQES YTFYVKAEDG GRVSRSSSAK VTINVVDVND NKPVFIVPPY NYSYELVLPS     720
TNPGTVVFQV IAVDNDTGMN AEVRYSIVGG NTRDLFAIDQ ETGNITLMEK CDVTDLGLHR     780
VLVKANDLGQ PDSLFSVVIV NLFVNESVTN ATLINELVRK SIEAPVTPNT EIADVSSPTS     840
DYVKILVAAV AGTITVVVVI FITAVVRCRQ APHLKAAQKN MQNSEWATPN PENRQMIMMK     900
KKKKKKKHSP KNLLLNVVTI EETKADDVDS DGNRVTLDLP IDLEEQTMGK YNWVTTPTTF     960
KPDSPDLARH YKSASPQPAF QIQPETPLNL KHHIIQELPL DNTFVACDSI SNCSSSSSDP    1020
```

Figure 12c (continued)

```
YSVSDCGYPV TTFEVPVSVH TRPSQRRVTF HLPEGSQESS SDGGLGDHDA GSLTSTSHGL    1080
PLGYPQEEYF DRATPSNRTE GDGNSDPEST FIPGLKKEIT VQPTVEEASD NCTQECLIYG    1140
HSDACWMPAS LDHSSSSQAQ ASALCHSPPL SQASTQHHSP PVTQTIVLCH SPPVTQTIAL    1200
CHSPPPIQVS ALHHSPPLVQ GTALHHSPPS AQASALCYSP PLAQAAAISH SSSLPQVIAL    1260
HRSQAQSSVS LQQGWVQGAN GLCSVDQGVQ GSATSQFYTM SERLHPSDDS IKVIPLTTFA    1320
PRQQARPSRG DSPIMETHPL                                               1340
```

Figure 13c Alignment of nucleotide sequences of 109P1D4 transcript variants

(data not shown)

Figure 14c Alignment of protein sequences of 109P1D4 transcript variants (SEQ ID NOS:26, 132, 133, 134, 135, 136, 137, 138).

```
109P1D4v.1      --------------------------------MDLLSGTYIFAVLLACVVFHSGAQEKNY 28
109P1D4v.2      --------------------------------MDLLSGTYIFAVLLACVVFHSGAQEKNY 28
109P1D4v.3      --------------------------------MDLLSGTYIFAVLLACVVFHSGAQEKNY 28
109P1D4v.4      --------------------------------MDLLSGTYIFAVLLACVVFHSGAQEKNY 28
109P1D4v.5      --------------------------------MDLLSGTYIFAVLLACVVFHSGAQEKNY 28
109P1D4v.6      ------MTVGFNSDIS-----SVVRVNTTNCHKCLLSGFYIFAVLLVCVVFHSGAQEKNY 49
109P1D4v.7      MFRVGFLIISSSSSLSPLLLVSVVRVNTTNCHKCLLSGFYIFAVLLVCVVFHSGAQEKNY 60
109P1D4v.8      MFRVGFLIISSSSSLSPLLLVSVVRVNTTNCHKCLLSGFYIFAVLLVCVVFHSGAQEKNY 60
                                                   ************.************

109P1D4v.1      TIREEMPENVLIGDLLKDLNLSLIPNKSLTTAMQFKLVYKTGDVPLIRIEEDTGEIFTTG 88
109P1D4v.2      TIREEMPENVLIGDLLKDLNLSLIPNKSLTTAMQFKLVYKTGDVPLIRIEEDTGEIFTTG 88
109P1D4v.3      TIREEMPENVLIGDLLKDLNLSLIPNKSLTTAMQFKLVYKTGDVPLIRIEEDTGEIFTTG 88
109P1D4v.4      TIREEMPENVLIGDLLKDLNLSLIPNKSLTTAMQFKLVYKTGDVPLIRIEEDTGEIFTTG 88
109P1D4v.5      TIREEMPENVLIGDLLKDLNLSLIPNKSLTTAMQFKLVYKTGDVPLIRIEEDTGEIFTTG 88
109P1D4v.6      TIREEIPENVLIGNLLKDLNLSLIPNKSLTTTMQFKLVYKTGDVPLIRIEEDTGEIFTTG 109
109P1D4v.7      TIREEIPENVLIGNLLKDLNLSLIPNKSLTTTMQFKLVYKTGDVPLIRIEEDTGEIFTTG 120
109P1D4v.8      TIREEIPENVLIGNLLKDLNLSLIPNKSLTTTMQFKLVYKTGDVPLIRIEEDTGEIFTTG 120
                *****:*******:*****************:****************************

109P1D4v.1      ARIDREKLCAGIPRDEHCFYEVEVAILPDEIFRLVKIRFLIEDINDNAPLFPATVINISI 148
109P1D4v.2      ARIDREKLCAGIPRDEHCFYEVEVAILPDEIFRLVKIRFLIEDINDNAPLFPATVINISI 148
109P1D4v.3      ARIDREKLCAGIPRDEHCFYEVEVAILPDEIFRLVKIRFLIEDINDNAPLFPATVINISI 148
```

Figure 14c (continued)

```
109P1D4v.4      ARIDREKLCAGIPRDEHCFYEVEVAILPDEIFRLVKIRFLIEDINDNAPLFPATVINISI 148
109P1D4v.5      ARIDREKLCAGIPRDEHCFYEVEVAILPDEIFRLVKIRFLIEDINDNAPLFPATVINISI 148
109P1D4v.6      ARIDREKLCAGIPRDEHCFYEVEVAILPDEIFRLVKIRFLIEDINDNAPLFPATVINISI 169
109P1D4v.7      ARIDREKLCAGIPRDEHCFYEVEVAILPDEIFRLVKIRFLIEDINDNAPLFPATVINISI 180
109P1D4v.8      ARIDREKLCAGIPRDEHCFYEVEVAILPDEIFRLVKIRFLIEDINDNAPLFPATVINISI 180
                ************************************************************

109P1D4v.1      PENSAINSKYTLPAAVDPDVGINGVQNYELIKSQNIFGLDVIETPEGDKMPQLIVQKELD 208
109P1D4v.2      PENSAINSKYTLPAAVDPDVGINGVQNYELIKSQNIFGLDVIETPEGDKMPQLIVQKELD 208
109P1D4v.3      PENSAINSKYTLPAAVDPDVGINGVQNYELIKSQNIFGLDVIETPEGDKMPQLIVQKELD 208
109P1D4v.4      PENSAINSKYTLPAAVDPDVGINGVQNYELIKSQNIFGLDVIETPEGDKMPQLIVQKELD 208
109P1D4v.5      PENSAINSKYTLPAAVDPDVGINGVQNYELIKSQNIFGLDVIETPEGDKMPQLIVQKELD 208
109P1D4v.6      PENSAINSKYTLPAAVDPDVGINGVQNYELIKSQNIFGLDVIETPEGDKMPQLIVQKELD 229
109P1D4v.7      PENSAINSKYTLPAAVDPDVGINGVQNYELIKSQNIFGLDVIETPEGDKMPQLIVQKELD 240
109P1D4v.8      PENSAINSKYTLPAAVDPDVGINGVQNYELIKSQNIFGLDVIETPEGDKMPQLIVQKELD 240
                ************************************************************

109P1D4v.1      REEKDTYVMKVKVEDGGFPQRSSTAILQVSVTDTNDNHPVFKETEIEVSIPENAPVGTSV 268
109P1D4v.2      REEKDTYVMKVKVEDGGFPQRSSTAILQVSVTDTNDNHPVFKETEIEVSIPENAPVGTSV 268
109P1D4v.3      REEKDTYVMKVKVEDGGFPQRSSTAILQVSVTDTNDNHPVFKETEIEVSIPENAPVGTSV 268
109P1D4v.4      REEKDTYVMKVKVEDGGFPQRSSTAILQVSVTDTNDNHPVFKETEIEVSIPENAPVGTSV 268
109P1D4v.5      REEKDTYVMKVKVEDGGFPQRSSTAILQVSVTDPNANHPVFKEPEIEVSIPENAPVGTSV 268
109P1D4v.6      REEKDTYVMKVKVEDGGFPQRSSTAILQVSVTDTNDNHPVFKETEIEVSIPENAPVGTSV 289
109P1D4v.7      REEKDTYVMKVKVEDGGFPQRSSTAILQVSVTDTNDNHPVFKETEIEVSIPENAPVGTSV 300
109P1D4v.8      REEKDTYVMKVKVEDGGFPQRSSTAILQVSVTDTNDNHPVFKETEIEVSIPENAPVGTSV 300
                *********************************.* *******.****************

109P1D4v.1      TQLHATDADIGENAKIHFSFSNLVSNIARRLFHLNATTGLITIKEPLDREETPNHKLLVL 328
109P1D4v.2      TQLHATDADIGENAKIHFSFSNLVSNIARRLFHLNATTGLITIKEPLDREETPNHKLLVL 328
109P1D4v.3      TQLHATDADIGENAKIHFSFSNLVSNIARRLFHLNATTGLITIKEPLDREETPNHKLLVL 328
109P1D4v.4      TQLHATDADIGENAKIHFSFSNLVSNIARRLFHLNATTGLITIKEPLDREETPNHKLLVL 328
109P1D4v.5      TQLHATDADIGENAKIHFSFSNLVSNIARRLFHLNATTGLITIKEPLDREETPNHKLLVL 328
109P1D4v.6      TQLHATDADIGENAKIHFSFSNLVSNIARRLFHLNATTGLITIKEPLDREETPNHKLLVL 349
109P1D4v.7      TQLHATDADIGENAKIHFSFSNLVSNIARRLFHLNATTGLITIKEPLDREETPNHKLLVL 360
109P1D4v.8      TQLHATDADIGENAKIHFSFSNLVSNIARRLFHLNATTGLITIKEPLDREETPNHKLLVL 360
                ************************************************************

109P1D4v.1      ASDGGLMPARAMVLVNVTDVNDNVPSIDIRYIVNPVNDTVVLSENIPLNTKIALITVTDK 388
109P1D4v.2      ASDGGLMPARAMVLVNVTDVNDNVPSIDIRYIVNPVNDTVVLSENIPLNTKIALITVTDK 388
```

Figure 14c (continued)

```
109P1D4v.3      ASDGGLMPARAMVLVNVTDVNDNVPSIDIRYIVNPVNDTVVLSENIPLNTKIALITVTDK 388
109P1D4v.4      ASDGGLMPARAMVLVNVTDVNDNVPSIDIRYIVNPVNDTVVLSENIPLNTKIALITVTDK 388
109P1D4v.5      ASDGGLMPARAMVLVNVTDVNDNVPSIDIRYIVNPVNDTVVLSENIPLNTKIALITVTDK 388
109P1D4v.6      ASDGGLMPARAMVLVNVTDVNDNVPSIDIRYIVNPVNDTVVLSENIPLNTKIALITVTDK 409
109P1D4v.7      ASDGGLMPARAMVLVNVTDVNDNVPSIDIRYIVNPVNDTVVLSENIPLNTKIALITVTDK 420
109P1D4v.8      ASDGGLMPARAMVLVNVTDVNDNVPSIDIRYIVNPVNDTVVLSENIPLNTKIALITVTDK 420
                ************************************************************

109P1D4v.1      DADHNGRVTCFTDHEIPFRLRPVFSNQFLLETAAYLDYESTKEYAIKLLAADAGKPPLNQ 448
109P1D4v.2      DADHNGRVTCFTDHEIPFRLRPVFSNQFLLETAAYLDYESTKEYAIKLLAADAGKPPLNQ 448
109P1D4v.3      DADHNGRVTCFTDHEIPFRLRPVFSNQFLLETAAYLDYESTKEYAIKLLAADAGKPPLNQ 448
109P1D4v.4      DADHNGRVTCFTDHEIPFRLRPVFSNQFLLETAAYLDYESTKEYAIKLLAADAGKPPLNQ 448
109P1D4v.5      DADHNGRVTCFTDHEIPFRLRPVFSNQFLLETAAYLDYESTKEYAIKLLAADAGKPPLNQ 448
109P1D4v.6      DADHNGRVTCFTDHEIPFRLRPVFSNQFLLENAAYLDYESTKEYAIKLLAADAGKPPLNQ 469
109P1D4v.7      DADHNGRVTCFTDHEIPFRLRPVFSNQFLLENAAYLDYESTKEYAIKLLAADAGKPPLNQ 480
109P1D4v.8      DADHNGRVTCFTDHEIPFRLRPVFSNQFLLENAAYLDYESTKEYAIKLLAADAGKPPLNQ 480
                ******************************.*****************************

109P1D4v.1      SAMLFIKVKDENDNAPVFTQSFVTVSIPENNSPGIQLTKVSAMDADSGPNAKINYLLGPD 508
109P1D4v.2      SAMLFIKVKDENDNAPVFTQSFVTVSIPENNSPGIQLTKVSAMDADSGPNAKINYLLGPD 508
109P1D4v.3      SAMLFIKVKDENDNAPVFTQSFVTVSIPENNSPGIQLTKVSAMDADSGPNAKINYLLGPD 508
109P1D4v.4      SAMLFIKVKDENDNAPVFTQSFVTVSIPENNSPGIQLTKVSAMDADSGPNAKINYLLGPD 508
109P1D4v.5      SAMLFIKVKDENDNAPVFTQSFVTVSIPENNSPGIQLTKVSAMDADSGPNAKINYLLGPD 508
109P1D4v.6      SAMLFIKVKDENDNAPVFTQSFVTVSIPENNSPGIQLMKVSATDADSGPNAEINYLLGPD 529
109P1D4v.7      SAMLFIKVKDENDNAPVFTQSFVTVSIPENNSPGIQLMKVSATDADSGPNAEINYLLGPD 540
109P1D4v.8      SAMLFIKVKDENDNAPVFTQSFVTVSIPENNSPGIQLMKVSATDADSGPNAEINYLLGPD 540
                ************************************* **** ********:********

109P1D4v.1      APPEFSLDCRTGMLTVVKKLDREKEDKYLFTILAKDNGVPPLTSNVTVFVSIIDQNDNSP 568
109P1D4v.2      APPEFSLDCRTGMLTVVKKLDREKEDKYLFTILAKDNGVPPLTSNVTVFVSIIDQNDNSP 568
109P1D4v.3      APPEFSLDCRTGMLTVVKKLDREKEDKYLFTILAKDNGVPPLTSNVTVFVSIIDQNDNSP 568
109P1D4v.4      APPEFSLDCRTGMLTVVKKLDREKEDKYLFTILAKDNGVPPLTSNVTVFVSIIDQNDNSP 568
109P1D4v.5      APPEFSLDCRTGMLTVVKKLDREKEDKYLFTILAKDNGVPPLTSNVTVFVSIIDQNDNSP 568
109P1D4v.6      APPEFSLDRRTGMLTVVKKLDREKEDKYLFTILAKDNGVPPLTSNVTVFVSIIDQNDNSP 589
109P1D4v.7      APPEFSLDRRTGMLTVVKKLDREKEDKYLFTILAKDNGVPPLTSNVTVFVSIIDQNDNSP 600
109P1D4v.8      APPEFSLDRRTGMLTVVKKLDREKEDKYLFTILAKDNGVPPLTSNVTVFVSIIDQNDNSP 600
                ******** ***************************************************

109P1D4v.1      VFTHNEYNFYVPENLPRHGTVGLITVTDPDYGDNSAVTLSILDENDDFTIDSQTGVIRPN 628
```

Figure 14c (continued)

```
109P1D4v.2     VFTHNEYNFYVPENLPRHGTVGLITVTDPDYGDNSAVTLSILDENDDFTIDSQTGVIRPN 628
109P1D4v.3     VFTHNEYNFYVPENLPRHGTVGLITVTDPDYGDNSAVTLSILDENDDFTIDSQTGVIRPN 628
109P1D4v.4     VFTHNEYNFYVPENLPRHGTVGLITVTDPDYGDNSAVTLSILDENDDFTIDSQTGVIRPN 628
109P1D4v.5     VFTHNEYNFYVPENLPRHGTVGLITVTDPDYGDNSAVTLSILDENDDFTIDSQTGVIRPN 628
109P1D4v.6     VFTHNEYKFYVPENLPRHGTVGLITVTDPDYGDNSAVTLSILDENDDFTIDSQTGVIRPN 649
109P1D4v.7     VFTHNEYKFYVPENLPRHGTVGLITVTDPDYGDNSAVTLSILDENDDFTIDSQTGVIRPN 660
109P1D4v.8     VFTHNEYKFYVPENLPRHGTVGLITVTDPDYGDNSAVTLSILDENDDFTIDSQTGVIRPN 660
               *******:****************************************************

109P1D4v.1     ISFDREKQESYTFYVKAEDGGRVSRSSSAKVTINVVDVNDNKPVFIVPPSNCSYELVLPS 688
109P1D4v.2     ISFDREKQESYTFYVKAEDGGRVSRSSSAKVTINVVDVNDNKPVFIVPPSNCSYELVLPS 688
109P1D4v.3     ISFDREKQESYTFYVKAEDGGRVSRSSSAKVTINVVDVNDNKPVFIVPPSNCSYELVLPS 688
109P1D4v.4     ISFDREKQESYTFYVKAEDGGRVSRSSSAKVTINVVDVNDNKPVFIVPPSNCSYELVLPS 688
109P1D4v.5     ISFDREKQESYTFYVKAEDGGRVSRSSSAKVTINVVDVNDNKPVFIVPPSNCSYELVLPS 688
109P1D4v.6     ISFDREKQESYTFYVKAEDGGRVSRSSSAKVTINVVDVNDNKPVFIVPPYNYSYELVLPS 709
109P1D4v.7     ISFDREKQESYTFY-KAEDGGRVSRSSSAKVTINVVDVNDNKPVFIVPPYNYSYELVLPS 719
109P1D4v.8     ISFDREKQESYTFYVKAEDGGRVSRSSSAKVTINVVDVNDNKPVFIVPPYNYSYELVLPS 720
               ************** ********************************** * ********

109P1D4v.1     TNPGTVVFQVIAVDNDTGMNAEVCYSIVGGNTRDLFAIDQETGNITLMEKCDVTDLGLHR 748
109P1D4v.2     TNPGTVVFQVIAVDNDTGMNAEVRYSIVGGNTRDLFAIDQETGNITLMEKCDVTDLGLHR 748
109P1D4v.3     TNPGTVVFQVIAVDNDTGMNAEVRYSIVGGNTRDLFAIDQETGNITLMEKCDVTDLGLHR 748
109P1D4v.4     TNPGTVVFQVIAVDNDTGMNAEVRYSIVGGNTRDLFAIDQETGNITLMEKCDVTDLGLHR 748
109P1D4v.5     TNPGTVVFQVIAVDNDTGMNAEVRYSIVGGNTRDLFAIDQETGNITLMEKCDVTDLGLHR 748
109P1D4v.6     TNPGTVVFQVIAVDNDTGMNAEVRYSIVGGNTRDLFAIDQETGNITLMEKCDVTDLGLHR 769
109P1D4v.7     TNPGTVVFQVIAVDNDTGMNAEVRYSIVGGNTRDLFAIDQETGNITLMEKCDVTDLGLHR 779
109P1D4v.8     TNPGTVVFQVIAVDNDTGMNAEVRYSIVGGNTRDLFAIDQETGNITLMEKCDVTDLGLHR 780
               *********************** ************************************

109P1D4v.1     VLVKANDLGQPDSLFSVVIVNLFVNESVTNATLINELVRKSTEAPVTPNTEIADVSSPTS 808
109P1D4v.2     VLVKANDLGQPDSLFSVVIVNLFVNESVTNATLINELVRKSTEAPVTPNTEIADVSSPTS 808
109P1D4v.3     VLVKANDLGQPDSLFSVVIVNLFVNESVTNATLINELVRKSTEAPVTPNTEIADVSSPTS 808
109P1D4v.4     VLVKANDLGQPDSLFSVVIVNLFVNESVTNATLINELVRKSTEAPVTPNTEIADVSSPTS 808
109P1D4v.5     VLVKANDLGQPDSLFSVVIVNLFVNESVTNATLINELVRKSTEAPVTPNTEIADVSSPTS 808
109P1D4v.6     VLVKANDLGQPDSLFSVVIVNLFVNESVTNATLINELVRKSIEAPVTPNTEIADVSSPTS 829
109P1D4v.7     VLVKANDLGQPDSLFSVVIVNLFVNESVTNATLINELVRKSIEAPVTPNTEIADVSSPTS 839
109P1D4v.8     VLVKANDLGQPDSLFSVVIVNLFVNESVTNATLINELVRKSIEAPVTPNTEIADVSSPTS 840
               ***************************************** ******************
```

Figure 14c (continued)

```
109P1D4v.1      DYVKILVAAVAGTITVVVVIFITAVVRCRQAPHLKAAQKNKQNSEWATPNPENRQMIMMK 868
109P1D4v.2      DYVKILVAAVAGTITVVVVIFITAVVRCRQAPHLKAAQKNKQNSEWATPNPENRQMIMMK 868
109P1D4v.3      DYVKILVAAVAGTITVVVVIFITAVVRCRQAPHLKAAQKNKQNSEWATPNPENRQMIMMK 868
109P1D4v.4      DYVKILVAAVAGTITVVVVIFITAVVRCRQAPHLKAAQKNKQNSEWATPNPENRQMIMMK 868
109P1D4v.5      DYVKILVAAVAGTITVVVVIFITAVVRCRQAPHLKAAQKNKQNSEWATPNPENRQMIMMK 868
109P1D4v.6      DYVKILVAAVAGTITVVVVIFITAVVRCRQAPHLKAAQKNMQNSEWATPNPENRQMIMMK 889
109P1D4v.7      DYVKILVAAVAGTITVVVVIFITAVVRCRQAPHLKAAQKNMQNSEWATPNPENRQMIMMK 899
109P1D4v.8      DYVKILVAAVAGTITVVVVIFITAVVRCRQAPHLKAAQKNMQNSEWATPNPENRQMIMMK 900
                **************************************** *******************

109P1D4v.1      KKKKKKKHSPKNLLLNFVTIEETKADDVDSDGNRVTLDLPIDLEEQTMGKYNWVTTPTTF 928
109P1D4v.2      KKKKKKKHSPKNLLLNFVTIEETKADDVDSDGNRVTLDLPIDLEEQTMGKYNWVTTPTTF 928
109P1D4v.3      KKKKKKKHSPKNLLLNFVTIEETKADDVDSDGNRVTLDLPIDLEEQTMGKYNWVTTPTTF 928
109P1D4v.4      KKKKKKKHSPKNLLLNFVTIEETKADDVDSDGNRVTLDLPIDLEEQTMGKYNWVTTPTTF 928
109P1D4v.5      KKKKKKKHSPKNLLLNFVTIEETKADDVDSDGNRVTLDLPIDLEEQTMGKYNWVTTPTTF 928
109P1D4v.6      KKKKKKKHSPKNLLLNFVTIEETKADDVDSDGNRVTLDLPIDLEEQTMGKYNWVTTPTTF 949
109P1D4v.7      KKKKKKKHSPKNLLLNVVTIEETKADDVDSDGNRVTLDLPIDLEEQTMGKYNWVTTPTTF 959
109P1D4v.8      KKKKKKKHSPKNLLLNVVTIEETKADDVDSDGNRVTLDLPIDLEEQTMGKYNWVTTPTTF 960
                ****************.*******************************************

109P1D4v.1      KPDSPDLARHYKSASPQPAFQIQPETPLNSKHHIIQELPLDNTFVACDSISKCSSSSSDP 988
109P1D4v.2      KPDSPDLARHYKSASPQPAFQIQPETPLNSKHHIIQELPLDNTFVACDSISKCSSSSSDP 988
109P1D4v.3      KPDSPDLARHYKSASPQPAFQIQPETPLNSKHHIIQELPLDNTFVACDSISKCSSSSSDP 988
109P1D4v.4      KPDSPDLARHYKSASPQPAFQIQPETPLNSKHHIIQELPLDNTFVACDSISKCSSSSSDP 988
109P1D4v.5      KPDSPDLARHYKSASPQPAFQIQPETPLNSKHHIIQELPLDNTFVACDSISKCSSSSSDP 988
109P1D4v.6      KPDSPDLARHYKSASPQPAFQIQPETPLNLKHHIIQELPLDNTFVACDSISKCSSSSSDP 1009
109P1D4v.7      KPDSPDLARHYKSASPQPAFQIQPETPLNLKHHIIQELPLDNTFVACDSISNCSSSSSDP 1019
109P1D4v.8      KPDSPDLARHYKSASPQPAFQIQPETPLNLKHHIIQELPLDNTFVACDSISNCSSSSSDP 1020
                ***************************** *********************:********

109P1D4v.1      YSVSDCGYPVTTFEVPVSVHTRP------------------------------------- 1011
109P1D4v.2      YSVSDCGYPVTTFEVPVSVHTRP------------------------------------- 1011
109P1D4v.3      YSVSDCGYPVTTFEVPVSVHTRPPMKEVVRSCTPMKESTTMEIWIHPQPQRKSEGKVAGK 1048
109P1D4v.4      YSVSDCGYPVTTFEVPVSVHTRPPMKEVVRSCTPMKESTTMEIWIHPQPQ---------- 1038
109P1D4v.5      YSVSDCGYPVTTFEVPVSVHTRP------------------------------------- 1011
109P1D4v.6      YSVSDCGYPVTTFEVPVSVHTRP------------------------------------- 1032
109P1D4v.7      YSVSDCGYPVTTFEVPVSVHTRP------------------------------------- 1042
109P1D4v.8      YSVSDCGYPVTTFEVPVSVHTRP------------------------------------- 1043
                ***********************
```

Figure 14c (continued)

```
109P1D4v.1      ----------VGIQVSN------------------------------------------- 1018
109P1D4v.2      ----------TDSRTST------------------------------------------- 1018
109P1D4v.3      SQRRVTFHLPEGSQESSSDGGLGDHDAGSLTSTSHGLPLGYPQEEYFDRATPSNRTEGDG 1108
109P1D4v.4      SQRRVTFHLPEGSQESSSDGGLGDHDAGSLTSTSHGLPLGYPQEEYFDRATPSNRTEGDG 1098
109P1D4v.5      SQRRVTFHLPEGSQESSSDGGLGDHDAGSLTSTSHGLPLGYPQEEYFDRATPSNRTEGDG 1071
109P1D4v.6      ----------TDSRT--------------------------------------------- 1037
109P1D4v.7      ----------TDSRT--------------------------------------------- 1047
109P1D4v.8      ----------SQRRVTFHLPEGSQESSSDGGLGDHDAGSLTSTSHGLPLGYPQEEYFDRA 1093
                          :

109P1D4v.1      -----TTF---------------------------------------------------- 1021
109P1D4v.2      -----------IEICSEI------------------------------------------ 1025
109P1D4v.3      NSDPESTFIPGLKKAAEITVQPTVEEASDNCTQECLIYGHSDACWMPASLDHSSSSQAQA 1168
109P1D4v.4      NSDPESTFIPGLKKAAEITVQPTVEEASDNCTQECLIYGHSDACWMPASLDHSSSSQAQA 1158
109P1D4v.5      NSDPESTFIPGLKKAAEITVQPTVEEASDNCTQECLIYGHSDACWMPASLDHSSSSQAQA 1131
109P1D4v.6      ------------------------------------------------------------
109P1D4v.7      ------------------------------------------------------------
109P1D4v.8      TPSNRTEGDGNSDPESTFIPGLKKEITVQPTVEEASDNCTQECLIYGHSDACWMPASLDH 1153

109P1D4v.1      ------------------------------------------------------------
109P1D4v.2      ------------------------------------------------------------
109P1D4v.3      SALCHSPPLSQASTQHHSPRVTQTIALCHSPPVTQTIALCHSPPPIQVSALHHSPPLVQA 1228
109P1D4v.4      SALCHSPPLSQASTQHHSPRVTQTIALCHSPPVTQTIALCHSPPPIQVSALHHSPPLVQA 1218
109P1D4v.5      SALCHSPPLSQASTQHHSPRVTQTIALCHSPPVTQTIALCHSPPPIQVSALHHSPPLVQA 1191
109P1D4v.6      ------------------------------------------------------------
109P1D4v.7      ------------------------------------------------------------
109P1D4v.8      SSSSQAQASALCHSPPLSQASTQHHSPPVTQTIVLCHSPPVTQTIALCHSPPPIQVSALH 1213

109P1D4v.1      ------------------------------------------------------------
109P1D4v.2      ------------------------------------------------------------
109P1D4v.3      TALHHSPPSAQASALCYSPPLAQAAAISHSSPLPQVIALHRSQAQSSVSLQQGWVQGADG 1288
109P1D4v.4      TALHHSPPSAQASALCYSPPLAQAAAISHSSPLPQVIALHRSQAQSSVSLQQGWVQGADG 1278
109P1D4v.5      TALHHSPPSAQASALCYSPPLAQAAAISHSSPLPQVIALHRSQAQSSVSLQQGWVQGADG 1251
109P1D4v.6      ------------------------------------------------------------
109P1D4v.7      ------------------------------------------------------------
109P1D4v.8      HSPPLVQGTALHHSPPSAQASALCYSPPLAQAAAISHSSSLPQVIALHRSQAQSSVSLQQ 1273
```

Figure 14c (continued)

```
109P1D4v.1      ------------------------------------------------------------
109P1D4v.2      ------------------------------------------------------------
109P1D4v.3      LCSVDQGVQGSATSQFYTMSERLHPSDDSIKVIPLTTFTPRQQARPSRGDSPIMEEHPL- 1347
109P1D4v.4      LCSVDQGVQGSATSQFYTMSERLHPSDDSIKVIPLTTFTPRQQARPSRGDSPIMEEHPL- 1337
109P1D4v.5      LCSVDQGVQGSATSQFYTMSERLHPSDDSIKVIPLTTFTPRQQARPSRGDSPIMEEHPL- 1310
109P1D4v.6      ------------------------------------------------------------
109P1D4v.7      ------------------------------------------------------------
109P1D4v.8      GWVQGANGLCSVDQGVQGSATSQFYTMSERLHPSDDSIKVIPLTTFAPRQQARPSRGDSP 1333

109P1D4v.1      -------
109P1D4v.2      -------
109P1D4v.3      -------
109P1D4v.4      -------
109P1D4v.5      -------
109P1D4v.6      -------
109P1D4v.7      -------
109P1D4v.8      IMETHPL 1340
```

Figure 11e Nucleotide sequences of transcript variants of 151P4E11

>151P4E11 v.2 (SEQ ID NO:139).

```
gaaggtcttg gaaaaggcgg tgttcattag aaatctcaaa accgagtcac caagttccct      60
ctgttggagc ccagtggagc ctctgggaga aaagctgggg tgacttttcc tacaaggggc     120
agagggactc tgctagattt ttgtttttca tttgtttttta attttgtaac atggaaactc    180
tttccttagg atataccagc tctcattact cagctaggaa ttatacctct ttaaagcctg     240
aatttaaaag tctgacagtt ttaaatgctt actaactgtg ggagttaaat cattacgaag     300
tgaggaatac agagtgttgt ccctgattct gggtttaatc tggtaagaat ctttacagag     360
gacgaccaca cgccgcttcc tgtagcatgt gtcgtggttg taattctctc atgtgcatat     420
taagaagttg ctgctcagat gtggctcttc cctttgcaga ggccggtgcc ctcgaccgcc     480
tcctggatct ccccgccgca gcctcctcag aagacatcga gcggtcctga gagcctcctg     540
ggcatgtttg tctgtgtgct gtaacctgaa gtcaaacctt aagataatgg ataatcttcg     600
gccaatttat gcagagtcag ccattcctgt tctctttgcc ttgatgttgt gttgttatca     660
tttaagattt tttttttttg gtaattattt tgagtggcaa aataaagaat agcaattact     720
tg                                                                    722
```

Figure 12e Protein sequences of transcript variants of 151P4E11
>151P4E11 v.2 (SEQ ID NO:140).
MCRGCNSIMG ILRSCCSDVA LPFAEAGALD RLLDLPAAAS SEDIERS          47

Figure 13e Alignment of nucleotide sequences of 151P4E11 transcript variants
(SEQ ID NOS:29, 139)

```
151P4E11v.1    ------------------------------------------------------------
151P4E11v.2    GAAGGTCTTGGAAAGCCGGTGTTCATTAGAAATCTAAAACCGAGTCACCAAGTTCCCT    60

151P4E11v.1    ------------------------------------------------------------
151P4E11v.2    CTGTTCGAGCCCAGTGGAGCCTCTGGGAGAGAAAGCTGGGGTGACTTTCCTACAAGGGGC   120

151P4E11v.1    AGATGGCCCGAGGCAGCCCCTCCCCTCGCTTCC----TCCTCGCCGCGGCCCTTT        57
151P4E11v.2    AGAGGGACTCTGCTAGATTTTGTTTTCATTTGTTTTAATTTGTAACATGGAAACTC       180
               *** *    * *** *   *  * *   *    *   *   *     * *

151P4E11v.1    CTGCCTCTGCGGG------GCTCTGGTCGCGCGGGCCAAGGAA--AAACGAGGCTGGACCCTG  110
151P4E11v.2    TTTCCTTAGGATATACCAGCTCCATTACTCAGCTAGGAATTATACCTCTTTAAAGCCTG      240
               * ***    *       ****

151P4E11v.1    AACAGCGCGGGTACCTGCT-----GGGCCCACATGCCGTTGGCAACCACAGTCATTCAG   166
151P4E11v.2    AATTTAAAAGTCTGACAGTTTTAAATGCTTACTAACTGTGGGAGTAATTCATTACGAAG   300
                 *  *  *** *****    *   *** *    *   *     *  * *

151P4E11v.1    CGACAAGAATGG--CCTCACCAGCAAGCGGGAGCCTGCGGCCG--AAGA-----TGACATGA  219
151P4E11v.2    TGAGGAATACAGAGTGTTGTCCCTGATTCTGGGTTTAATCTGGTAAGAATCTTTACAGAG    360
                * *     *    * * *   *         ** *     *   ****

151P4E11v.1    AAC-----CAGGAAGCTT----TGACAGGT-CCATACCTGAAAACAATATCATGCGCACA   269
151P4E11v.2    GAGGACCACACGCCCGCTTCCCGTCCTAGCATGCTGGTGGTCATGTCTGTAATTC-TCTCATGTGCATA   419
               * *       **   **   *   *  *  *  *  *  *  ***** ***  *

151P4E11v.1    ATCATTGAGTTTCTGTCTT------TCTTGCATCTCTAAAGAGGCCGGTGCCCTCGACCG   322
151P4E11v.2    -TTAAGAAGTTGCTGCTCAGATGTGGCTCTCAGAGGCCGAGAGGCCGGTGCCCTCGACCG   478
                *   * ***    * *         ****                ************

151P4E11v.1    CCTCCCTGGATCTCCCGGCCGCGCCCAGCCTCTCAGAAGACATCGAGCCGTCCTGAGAGCCTCC   382
151P4E11v.2    CCTCCTGGATCTCCCGGCCGCGCCCAGCCTCCTCAGAAGACATCGAGCCGTCCTGAGAGCCTCC   538
               *****************************  *********************************
```

```
                    ************************************************************

151P4E11v.1         TGGGCACGTTTGTCTGTGTGCTGTAACCTGAAGTCAAACCTTAAGATAATGGATAATCTT 442
151P4E11v.2         TGGGCATGTTTGTCTGTGTGCTGTAACCTGAAGTCAAACCTTAAGATAATGGATAATCTT 598
                    ****** *****************************************************

151P4E11v.1         CGGCCAATTTATGCGGAGTCAGCCATTCCTGTTCTCTTTGCCTTGATGTTGTGTTGTTAT 502
151P4E11v.2         CGGCCAATTTATGCAGAGTCAGCCATTCCTGTTCTCTTTGCCTTGATGTTGTGTTGTTAT 658
                    ************** *********************************************

151P4E11v.1         CATTTAAGATTTTTTTTTTTTTGGTAATTATTTTGAGTGGCAAAATAAAGAATAGCAATTA 562
151P4E11v.2         CATTTAAGATTTTTTTTTTTTTGGTAATTATTTTGAGTGGCAAAATAAAGAATAGCAATTA 718
                    ************************************************************

151P4E11v.1         ----
151P4E11v.2         CTTG 722
```

Figure 14e Alignment of protein sequences of 151P4E11 transcript variants (SEQ ID NO:30, 140).

```
151P4E11v.1         MARGSALLLASLLLAAALSASAGLWSPAKEKRGWTLNSAGYLLGPHAVGNHRSFSDKNGL 60
151P4E11v.2         MCRG-------------------------------CNSLMCIL--------RSCCS---- 17
                    *.**                                **    :*        **  ..

151P4E11v.1         TSKRELRPEDDMKPGSFDRSIPENNIMRTIIEFLSFLHLKEAGALDRLLDLPAAASSEDI 120
151P4E11v.2         -----------------DVALP----------------FAEAGALDRLLDLPAAASSEDI 44
                                     * ::*                : ********************

151P4E11v.1         ERS 123
151P4E11v.2         ERS 47
                    ***
```

Figure 11j Nucleotide sequences of transcript variants of 161P2B7A

>161P2B7A v.2 (SEQ ID NO:141)

```
gccgcccagg attccacgag ggggaaggat tctctattct tttttgcgac aaatctggta      60
acaggatttg ctgtgctgtt ttcgtccgtg tgtgtgtgcg tgtgtgtgtg tgttcgtgtg     120
gatgcacgtg tggccccgct ggggtgcccc ctccagtgtc ccccggagctg aaagatcgca     180
aagaggatgc gaaagggatg gaggacgaag gccagaccaa aatcaagcag aggcgaagtc     240
```

Figure 11j (continued)

```
ggaccaattt caccctggaa caactcaatg agctggagag gctttttgac gagacccact     300
atcccgacgc cttcatgcga gaggaactga gccagcgact gggcctgtcg gaggcccgag     360
tgcaggtttg gtttcaaaat cgaagagcta aatgtagaaa acaagaaaat caactccata     420
aaggtgttct catagggggcc gccagccagt ttgaagcttg tagagtcgca ccttatgtca     480
acgtaggtgc tttaaggatg ccatttcagc aggttcaggc gcagctgcag ctggacagcg     540
ctgtggcgca cgcgcaccac cacctgcatc cgcacctggc cgcgcacgcg ccctacatga     600
tgttcccagc accgcccttc ggactgccgc tcgccacgct ggccgcggat tcggcttccg     660
ccgcctcggt agtggcggcc gcagcagccg ccaagaccac cagcaaggac tccagcatcg     720
ccgatctcag actgaaagcc aaaaagcacg ccgcagccct gggtctgtga cgccaacgcc     780
agcaccaatg tcgcgcctgt cccgcggcac tcagcctgca cgccctccgc gccccgctgc     840
ttctccgtta ccccttttgag acctcgggag ccggccctct tcccgcctca ctgaccatcc     900
ctcgtcccct atcgcatctt ggactcggaa agccagactc cacgcaggac cagggatctc     960
acgaggcacg caggctccgt ggctcctgcc cgttttccta ctcgagggcc tagaattggg    1020
ttttgtagga gcgggtttgg gggagtctgg agagagactg gacagggtag tgctggaacc    1080
gcggagtttg gctcaccgca aagctacaac gatggactct tgcatagaaa aaaaaaatct    1140
tgttaacaat gaaaaaatga gcaaacaaaa aaatcgaaag acaaacggga gagaaaaaga    1200
ggaaggcaac ttatttctta actgctattt ggcagaagct gaaattggag aaccaaggag    1260
caaaaacaaa ttttaaaatt aaagtatttt atacatttaa aaatatggaa aaacaaccca    1320
gacgattctc gagagactgg ggggagttac caacttaaat gtgtgtttta aaaaatgcgc    1380
taagaaggca aagcagaaag aagaggtata cttatttaaa aaactaagat gaaaaaagtg    1440
cgcaggtggg aagttcacag gttttgaaac tgaccttttt ctgcgaagtt cacgttaata    1500
cgagaaattt gatgagagag gcggggcctcc ttttacgttg aatcagatgc tttgagttta    1560
aacccaccat gtatggaaga gcaagaaaag agaaaatatt aaaacgagga gagagaaaaa    1620
taatggcaaa actgtctgga ctgctgacag taaattccgg tttgcatgga aaaaaaaaaa    1680
aaaaaaaaaa aaaaaa                                                    1696
```

>161P2B7A v.3 (SEQ ID NO:142).

```
gagcgccggg ctgacgtgcg gcggcgatgg aagaacttac ggcgttcgtc tccaagtctt      60
ttgaccagaa agtgaaggag aagaaggagg cgatcacgta ccgggaggtg ctggagagcg     120
ggccgctgcg cggggccaag gagccgaccg gctgcaccga ggcgggccgc gacgaccgca     180
gcagcccggc agtccgggcg gccggcggag gcggcggcgg aggaggcgga ggcggcggcg     240
gaggaggcgg aggaggtgta ggaggaggtg gagcaggcgg aggagctgga ggagggcgct     300
ctcccgtccg ggagctggac atgggcgccg ccgagagaag cagggagccc ggcagcccgc     360
ggctgacgga ggtgtccccg gagctgaaag atcgcaaaga cgatgcgaaa gggatggagg     420
acgaaggcca gaccaaaatc aagcagaggc gaagtcggac caatttcacc ctggaacaac     480
tcaatgagct ggagaggctt tttgacgaga cccactatcc cgacgccttc atgcgagagg     540
aactgagcca gcgactgggc ctgtcggagg cccgagtgca ggtttggttt caaaatcgaa     600
gagctaaatg tagaaaacaa gaaaatcaac tccataaagg tgttctcata ggggccgcca     660
gccagtttga agcttgtaga gtcgcacctt atgtcaacgt aggtgcttta aggatgccat     720
```

Figure 11j (continued)

```
ttcagcagga tagtcattgc aacgtgacgc ccttgccctt tcaggttcag gcgcagctgc     780
agctggacag cgctgtggcg cacgcgcacc accacctgca tccgcacctg gccgcgcacg     840
cgccctacat gatgttccca gcaccgccct tcggactgcc gctcgccacg ctggccgcgg     900
attcggcttc cgccgcctcg gtagtggcgg ccgcagcagc cgccaagacc accagcaagg     960
actccagcat cgccgatctc agactgaaag ccaaaaagca cgccgcagcc ctgggtctgt    1020
gacgccaacg ccagcaccaa tgtcgcgcct gtcccgcggc actcagcctg cacgccctcc    1080
gcgccccgct gcttctccgt tacccctttg agacctcggg agccggccct cttcccgcct    1140
cactgaccat ccctcgtccc ctatcgcatc ttggactcgg aaagccagac tccacgcagg    1200
accagggatc tcacgaggca cgcaggctcc gtggctcctg cccgttttcc tactcgaggg    1260
cctagaattg ggttttgtag gagcgggttt gggggagtct ggagagagac tggacagggt    1320
agtgctggaa ccgcggagtt tggctcaccg caaagctaca acgatggact cttgcataga    1380
aaaaaaaaat cttgttaaca atgaaaaaat gagcaaacaa aaaaatcgaa agacaaacgg    1440
gagagaaaaa gaggaaggca acttatttct taactgctat ttggcagaag ctgaaattgg    1500
agaaccaagg agcaaaaaca aattttaaaa ttaaagtatt ttatacattt aaaaatatgg    1560
aaaaacaacc cagacgattc tcgagagact gggggagtt accaacttaa atgtgtgttt     1620
taaaaaatgc gctaagaagg caaagcagaa agaagaggta tacttattta aaaaactaag    1680
atgaaaaaag tgcgcaggtg ggaagttcac aggttttgaa actgaccttt ttctgcgaag    1740
ttcacgttaa tacgagaaat ttgatgagag aggcgggcct ccttttacgt tgaatcagat    1800
gctttgagtt taaacccacc atgtatggaa gagcaagaaa agagaaaata ttaaaacgag    1860
gagagagaaa aataatggca aaactgtctg gactgctgac agtaaattcc ggtttgcatg    1920
gaaaaaaaaa aaaaaaaaaa aaaaaaaa                                      1948
```

Figure 12j Protein sequences of transcript variants of 161P2B7A

>161P2B7A v.2 (SEQ ID NO:143).

```
MEDEGQTKIK QRRSRTNFTL EQLNELERLF DETHYPDAFM REELSQRLGL SEARVQVWFQ     60
NRRAKCRKQE NQLHKGVLIG AASQFEACRV APYVNVGALR MPFQQVQAQL QLDSAVAHAH    120
HHLHPHLAAH APYMMFPAPP FGLPLATLAA DSASAASVVA AAAAAKTTSK DSSIADLRLK    180
AKKHAAALGL                                                           190
```

>161P2B7A v.3 (SEQ ID NO:144).

```
MEELTAFVSK SFDQKVKEKK EAITYREVLE SGPLRGAKEP TGCTEAGRDD RSSPAVRAAG     60
GGGGGGGGGG GGGGGGGVGG GGAGGGAGGG RSPVRELDMG AAERSREPGS PRLTEVSPEL    120
KDRKDDAKGM EDEGQTKIKQ RRSRTNFTLE QLNELERLFD ETHYPDAFMR EELSQRLGLS    180
EARVQVWFQN RRAKCRKQEN QLHKGVLIGA ASQFEACRVA PYVNVGALRM PFQQDSHCNV    240
TPLPFQVQAQ LQLDSAVAHA HHHLHPHLAA HAPYMMFPAP PFGLPLATLA ADSASAASVV    300
AAAAAAKTTS KDSSIADLRL KAKKHAAALG L                                   331
```

Figure 13j Alignment of nucleotide sequences of 161P2B7A transcript variants (SEQ ID NOS:39, 141, 142).

```
161P2B7Av.1      ------------------------------------------------------------
161P2B7Av.2      ------------------------------------------------------------
161P2B7Av.3      GAGCGCCGGGCTGACGTGCGGCGGCGATGGAAGAACTTACGGCGTTCGTCTCCAAGTCTT 60


161P2B7Av.1      ------------------------------------------------------------
161P2B7Av.2      ------------------------------------------------------------
161P2B7Av.3      TTGACCAGAAAGTGAAGGAGAAGAAGGAGGCGATCACGTACCGGGAGGTGCTGGAGAGCG 120


161P2B7Av.1      ------------------------------------------------------------
161P2B7Av.2      ------------------------------------------------------------
161P2B7Av.3      GGCCGCTGCGCGGGGCCAAGGAGCCGACCGGCTGCACCGAGGCGGGCCGCGACGACCGCA 180


161P2B7Av.1      ---------------------------------------GCCGCCCAGGATTCCACGAGG 21
161P2B7Av.2      ---------------------------------------GCCGCCCAGGATTCCACGAGG 21
161P2B7Av.3      GCAGCCCGGCAGTCCGGGCGGCCGGCGGAGGCGGCGGAGGAGGCGGAGGCGGCGGCG 240
                                                        *  *    ***  *  **  *

161P2B7Av.1      GGGAAGGATTCTCTATTCTTTTTTGCGACAAATCTGGTAACAGGATTTGCTGTGCTGTTT 81
161P2B7Av.2      GGGAAGGATTCTCTATTCTTTTTTGCGACAAATCTGGTAACAGGATTTGCTGTGCTGTTT 81
161P2B7Av.3      GAGGAGGCGGAGGAGGTGTAGGAGGAGGTGGAGCAGGCGG-AGGAGCTGGAGGAGGGCGC 299
                 * * ***         * *     * *    * * **     ****  **  *    *

161P2B7Av.1      TCGTCCGTGTGTGTGCGTGTGTGTGTGTTCGTGTGGATGCACGTGTGGCCCCGCTG 141
161P2B7Av.2      TCGTCCGTGTGTGTGCGTGTGTGTGTGTTCGTGTGGATGCACGTGTGGCCCCGCTG 141
161P2B7Av.3      TCTCCCGTCCGGGAGC-TGGACATGGGCGCCGCCGAGAGAA----GCAGGGAGCCCGGCAG 355
                 **  ****  * * *   *    ** * *    ** * * *    *  *  **** ** *

161P2B7Av.1      --GGGTGCCCCCTCCAGTGTCCCCGGAGCTGAAAGATCGCAAAGAGGATGCGAAAGGGAT 199
161P2B7Av.2      --GGGTGCCCCCTCCAGTGTCCCCGGAGCTGAAAGATCGCAAAGAGGATGCGAAAGGGAT 199
161P2B7Av.3      CCCGCGGCTGACGGAGGTGTCCCCGGAGCTGAAAGATCGCAAAGACGATGCGAAAGGGAT 415
                    *  **   *    ***************************** **************

161P2B7Av.1      GGAGGACGAAGGCCAGACCAAAATCAAGCAGAGGCGAAGTCGGACCAATTTCACCCTGGA 259
161P2B7Av.2      GGAGGACGAAGGCCAGACCAAAATCAAGCAGAGGCGAAGTCGGACCAATTTCACCCTGGA 259
161P2B7Av.3      GGAGGACGAAGGCCAGACCAAAATCAAGCAGAGGCGAAGTCGGACCAATTTCACCCTGGA 475
                 ************************************************************
```

Figure 13j (continued)

```
161P2B7Av.1      ACAACTCAATGAGCTGGAGAGGCTTTTTGACGAGACCCACTATCCCGACGCCTTCATGCG 319
161P2B7Av.2      ACAACTCAATGAGCTGGAGAGGCTTTTTGACGAGACCCACTATCCCGACGCCTTCATGCG 319
161P2B7Av.3      ACAACTCAATGAGCTGGAGAGGCTTTTTGACGAGACCCACTATCCCGACGCCTTCATGCG 535
                 ************************************************************

161P2B7Av.1      AGAGGAACTGAGCCAGCGACTGGGCCTGTCGGAGGCCCGAGTGCAGGTTTGGTTTCAAAA 379
161P2B7Av.2      AGAGGAACTGAGCCAGCGACTGGGCCTGTCGGAGGCCCGAGTGCAGGTTTGGTTTCAAAA 379
161P2B7Av.3      AGAGGAACTGAGCCAGCGACTGGGCCTGTCGGAGGCCCGAGTGCAGGTTTGGTTTCAAAA 595
                 ************************************************************

161P2B7Av.1      TCGAAGAGCTAAATGTAGAAAACAAGAAAATCAACTCCATAAAGGTGTTCTCATAGGGGC 439
161P2B7Av.2      TCGAAGAGCTAAATGTAGAAAACAAGAAAATCAACTCCATAAAGGTGTTCTCATAGGGGC 439
161P2B7Av.3      TCGAAGAGCTAAATGTAGAAAACAAGAAAATCAACTCCATAAAGGTGTTCTCATAGGGGC 655
                 ************************************************************

161P2B7Av.1      CGCCAGCCAGTTTGAAGCTTGTAGAGTCGCACCTTATGTCAACGTAGGTGCTTTAAGGAT 499
161P2B7Av.2      CGCCAGCCAGTTTGAAGCTTGTAGAGTCGCACCTTATGTCAACGTAGGTGCTTTAAGGAT 499
161P2B7Av.3      CGCCAGCCAGTTTGAAGCTTGTAGAGTCGCACCTTATGTCAACGTAGGTGCTTTAAGGAT 715
                 ************************************************************

161P2B7Av.1      GCCATTTCAGCAGG------------------------------------TTCAGGCGCA 523
161P2B7Av.2      GCCATTTCAGCAGG------------------------------------TTCAGGCGCA 523
161P2B7Av.3      GCCATTTCAGCAGGATAGTCATTGCAACGTGACGCCCTTGCCCTTTCAGGTTCAGGCGCA 775
                 **************                                    **********

161P2B7Av.1      GCTGCAGCTGGACAGCGCTGTGGCGCACGCGCACCACCACCTGCATCCGCACCTGGCCGC 583
161P2B7Av.2      GCTGCAGCTGGACAGCGCTGTGGCGCACGCGCACCACCACCTGCATCCGCACCTGGCCGC 583
161P2B7Av.3      GCTGCAGCTGGACAGCGCTGTGGCGCACGCGCACCACCACCTGCATCCGCACCTGGCCGC 835
                 ************************************************************

161P2B7Av.1      GCACGCGCCCTACATGATGTTCCCAGCACCGCCCTTCGGACTGCCGCTCGCCACGCTGGC 643
161P2B7Av.2      GCACGCGCCCTACATGATGTTCCCAGCACCGCCCTTCGGACTGCCGCTCGCCACGCTGGC 643
161P2B7Av.3      GCACGCGCCCTACATGATGTTCCCAGCACCGCCCTTCGGACTGCCGCTCGCCACGCTGGC 895
                 ************************************************************

161P2B7Av.1      CGCGGATTCGGCTTCCGCCGCCTCGGTAGTGGCGGCCGCAGCAGCCGCCAAGACCACCAG 703
161P2B7Av.2      CGCGGATTCGGCTTCCGCCGCCTCGGTAGTGGCGGCCGCAGCAGCCGCCAAGACCACCAG 703
161P2B7Av.3      CGCGGATTCGGCTTCCGCCGCCTCGGTAGTGGCGGCCGCAGCAGCCGCCAAGACCACCAG 955
                 ************************************************************
```

Figure 13j (continued)

```
161P2B7Av.1      CAAGAACTCCAGCATCGCCGATCTCAGACTGAAAGCCAAAAAGCACGCCGCAGCCCTGGG 763
161P2B7Av.2      CAAGGACTCCAGCATCGCCGATCTCAGACTGAAAGCCAAAAAGCACGCCGCAGCCCTGGG 763
161P2B7Av.3      CAAGGACTCCAGCATCGCCGATCTCAGACTGAAAGCCAAAAAGCACGCCGCAGCCCTGGG 1015
                 **** *******************************************************

161P2B7Av.1      TCTGTGACGCCAACGCCAGCACCAATGTCGCGCCTGTCCCGCGGCACTCAGCCTGCACGC 823
161P2B7Av.2      TCTGTGACGCCAACGCCAGCACCAATGTCGCGCCTGTCCCGCGGCACTCAGCCTGCACGC 823
161P2B7Av.3      TCTGTGACGCCAACGCCAGCACCAATGTCGCGCCTGTCCCGCGGCACTCAGCCTGCACGC 1075
                 ************************************************************

161P2B7Av.1      CCTCCGCGCCCCGCTGCTTCTCCGTTACCCCTTTGAGACCTCGGGAGCCGGCCCTCTTCC 883
161P2B7Av.2      CCTCCGCGCCCCGCTGCTTCTCCGTTACCCCTTTGAGACCTCGGGAGCCGGCCCTCTTCC 883
161P2B7Av.3      CCTCCGCGCCCCGCTGCTTCTCCGTTACCCCTTTGAGACCTCGGGAGCCGGCCCTCTTCC 1135
                 ************************************************************

161P2B7Av.1      CGCCTCACTGACCATCCCTCGTCCCCTATCGCATCTTGGACTCGGAAAGCCAGACTCCAC 943
161P2B7Av.2      CGCCTCACTGACCATCCCTCGTCCCCTATCGCATCTTGGACTCGGAAAGCCAGACTCCAC 943
161P2B7Av.3      CGCCTCACTGACCATCCCTCGTCCCCTATCGCATCTTGGACTCGGAAAGCCAGACTCCAC 1195
                 ************************************************************

161P2B7Av.1      GCAGGACCAGGGATCTCACGAGGCACGCAGGCTCCGTGGCTCCTGCCCGTTTTCCTACTC 1003
161P2B7Av.2      GCAGGACCAGGGATCTCACGAGGCACGCAGGCTCCGTGGCTCCTGCCCGTTTTCCTACTC 1003
161P2B7Av.3      GCAGGACCAGGGATCTCACGAGGCACGCAGGCTCCGTGGCTCCTGCCCGTTTTCCTACTC 1255
                 ************************************************************

161P2B7Av.1      GAGGGCCTAGAATTGGGTTTTGTAGGAGCGGGTTTGGGGGAGTCTGGAGAGAGACTGGAC 1063
161P2B7Av.2      GAGGGCCTAGAATTGGGTTTTGTAGGAGCGGGTTTGGGGGAGTCTGGAGAGAGACTGGAC 1063
161P2B7Av.3      GAGGGCCTAGAATTGGGTTTTGTAGGAGCGGGTTTGGGGGAGTCTGGAGAGAGACTGGAC 1315
                 ************************************************************

161P2B7Av.1      AGGGGAGTGCTGGAACCGCGGAGTTTGGCTCACCGCAAAGCTACAACGATGGACTCTTGC 1123
161P2B7Av.2      AGGGTAGTGCTGGAACCGCGGAGTTTGGCTCACCGCAAAGCTACAACGATGGACTCTTGC 1123
161P2B7Av.3      AGGGTAGTGCTGGAACCGCGGAGTTTGGCTCACCGCAAAGCTACAACGATGGACTCTTGC 1375
                 **** *******************************************************

161P2B7Av.1      ATAGAAAAAAAAA-TCTTGTTAACAATGAAAAAATGAGCAAACAAAAAAATCGAAAGACA 1182
161P2B7Av.2      ATAGAAAAAAAAAATCTTGTTAACAATGAAAAAATGAGCAAACAAAAAAATCGAAAGACA 1183
161P2B7Av.3      ATAGAAAAAAAAAATCTTGTTAACAATGAAAAAATGAGCAAACAAAAAAATCGAAAGACA 1435
                 ************* **********************************************
```

Figure 13j (continued)

```
161P2B7Av.1      AACGGGAGAGAAAAAGAGGAAGGAAACTTATTTCTTAACTGCTATTTGGCAGAAGCTGAA 1242
161P2B7Av.2      AACGGGAGAGAAAAAGAGGAAGGCAACTTATTTCTTAACTGCTATTTGGCAGAAGCTGAA 1243
161P2B7Av.3      AACGGGAGAGAAAAAGAGGAAGGCAACTTATTTCTTAACTGCTATTTGGCAGAAGCTGAA 1495
                 *********************** ************************************

161P2B7Av.1      ATTGGAGAACCAAGGAGCAAAAACAAATTTTAAAATTAAAGTATTTTATACATTTAAAAA 1302
161P2B7Av.2      ATTGGAGAACCAAGGAGCAAAAACAAATTTTAAAATTAAAGTATTTTATACATTTAAAAA 1303
161P2B7Av.3      ATTGGAGAACCAAGGAGCAAAAACAAATTTTAAAATTAAAGTATTTTATACATTTAAAAA 1555
                 ************************************************************

161P2B7Av.1      TATGGAAAAACAACCCAGACGATTCTCGAGAGACTGGGGGGAGTTACCAACTTAAATGTG 1362
161P2B7Av.2      TATGGAAAAACAACCCAGACGATTCTCGAGAGACTGGGGGGAGTTACCAACTTAAATGTG 1363
161P2B7Av.3      TATGGAAAAACAACCCAGACGATTCTCGAGAGACTGGGGGGAGTTACCAACTTAAATGTG 1615
                 ************************************************************

161P2B7Av.1      TGTTTTTAAAAATGCGCTAAGAAGGCAAAGCAGAAAGAAGAGGTATACTTATTTAAAAAA 1422
161P2B7Av.2      TGTTTTAAAAAATGCGCTAAGAAGGCAAAGCAGAAAGAAGAGGTATACTTATTTAAAAAA 1423
161P2B7Av.3      TGTTTTAAAAAATGCGCTAAGAAGGCAAAGCAGAAAGAAGAGGTATACTTATTTAAAAAA 1675
                 ****** *****************************************************

161P2B7Av.1      CTAAGATGAAAAAAGTGCGCAGCTGGGAAGTTCACAGGTTTTGAAACTGACCTTTTTCTG 1482
161P2B7Av.2      CTAAGATGAAAAAAGTGCGCAGGTGGGAAGTTCACAGGTTTTGAAACTGACCTTTTTCTG 1483
161P2B7Av.3      CTAAGATGAAAAAAGTGCGCAGGTGGGAAGTTCACAGGTTTTGAAACTGACCTTTTTCTG 1735
                 ********************** *************************************

161P2B7Av.1      CGAAGTTCACGTTAATACGAGAAATTTGATGAGAGAGGCGG---CTCTTTTACGTTGAAT 1539
161P2B7Av.2      CGAAGTTCACGTTAATACGAGAAATTTGATGAGAGAGGCGGGCCTCCTTTTACGTTGAAT 1543
161P2B7Av.3      CGAAGTTCACGTTAATACGAGAAATTTGATGAGAGAGGCGGGCCTCCTTTTACGTTGAAT 1795
                 ****************************************      **************

161P2B7Av.1      CAGATGCTTTGAGTTTAAAACCCACCATGTATGGAAGAGCAAGAAAAGAGAAAATATTAA 1599
161P2B7Av.2      CAGATGCTTTGAGTTTAAA-CCCACCATGTATGGAAGAGCAAGAAAAGAGAAAATATTAA 1602
161P2B7Av.3      CAGATGCTTTGAGTTTAAA-CCCACCATGTATGGAAGAGCAAGAAAAGAGAAAATATTAA 1854
                 ******************* ****************************************

161P2B7Av.1      AACGAGGAGAGAGAAAAATAATATTAACACAAAAAAATGCCACAGACAATGATTTCTCTG 1659
161P2B7Av.2      AACGAGGAGAGAGAAAAATAATGGCAAAACTGTCTGG-ACTGCTGACAGTAAATTCC--- 1658
161P2B7Av.3      AACGAGGAGAGAGAAAAATAATGGCAAAACTGTCTGG-ACTGCTGACAGTAAATTCC--- 1910
                 **********************    ** **          *  * **** * * ***
```

Figure 13j (continued)

```
161P2B7Av.1      AGAAATTATTATGGCAAAACTGTCTGGACTGCTGACAGTAAATTCCGGTTTGCATGTTAC 1719
161P2B7Av.2      ---GGTTTGCATGGAAAAAAAAAAAAAAAAAAAAAAAAAAA------------------- 1696
161P2B7Av.3      ---GGTTTGCATGGAAAAAAAAAAAAAAAAAAAAAAAAAAA------------------- 1948
                      **   **** ****        *      * *  **

161P2B7Av.1      TTGTATTCCATTGATGGTGTGTCTTCCTCCCACCCCCTTATCTCCCATGCACTCACTCCA 1779
161P2B7Av.2      ------------------------------------------------------------
161P2B7Av.3      ------------------------------------------------------------

161P2B7Av.1      TTTTCATCTTCACTATGAAAAACAATACCAAAAGTATCTGGAAATTGATATATATATATC 1839
161P2B7Av.2      ------------------------------------------------------------
161P2B7Av.3      ------------------------------------------------------------

161P2B7Av.1      CACATATATATATCATATATTTGCCATATATATATATATATATATATATATATATATATA 1899
161P2B7Av.2      ------------------------------------------------------------
161P2B7Av.3      ------------------------------------------------------------

161P2B7Av.1      TATATATATATATATTTGCCCTGTCTTTGATCCTGGGGAACAAAAGAAAAAAGTCAGAAA 1959
161P2B7Av.2      ------------------------------------------------------------
161P2B7Av.3      ------------------------------------------------------------

161P2B7Av.1      GGGAAAAAATTACACTCATTGCCCTAAGAAGACAGAGGTGGGCAGAATATGTGGGGAAAG 2019
161P2B7Av.2      ------------------------------------------------------------
161P2B7Av.3      ------------------------------------------------------------

161P2B7Av.1      GAAAAGAAAACAAGACCACCAAATGAAATAATGAAGGTACAGCGCCTCGCTGTGCCAGA 2079
161P2B7Av.2      ------------------------------------------------------------
161P2B7Av.3      ------------------------------------------------------------

161P2B7Av.1      CACAGTAGGCGCTCAATCAGTATTAGTTCCCACCATTCCCCTTTTCTTGTGTTCCTTCTT 2139
161P2B7Av.2      ------------------------------------------------------------
161P2B7Av.3      ------------------------------------------------------------
```

Figure 13j (continued)

```
161P2B7Av.1      GTTGGTTTCCTGAAGTCCTATTTGAAGACAGTGGTTTATTTCCCCCTCTCTATCCCGTCA 2199
161P2B7Av.2      ------------------------------------------------------------
161P2B7Av.3      ------------------------------------------------------------

161P2B7Av.1      AATTCACCTTAAATAACACCCAGCTAGATACAGGCACTAGGTTTGTGTAAGATATGTTGA 2259
161P2B7Av.2      ------------------------------------------------------------
161P2B7Av.3      ------------------------------------------------------------

161P2B7Av.1      TACACACGAACAAAGTTTATTTTGACTATAATGTGTGGACTGACTTTCAACATTTGCATT 2319
161P2B7Av.2      ------------------------------------------------------------
161P2B7Av.3      ------------------------------------------------------------

161P2B7Av.1      TTATCTCACAAAGGTGTATCTATTCAAGTAACCTTTTTTTTTTTGTTTGTTTGTTTCTTT 2379
161P2B7Av.2      ------------------------------------------------------------
161P2B7Av.3      ------------------------------------------------------------

161P2B7Av.1      TTTGTTTTTTTTTTTCTTTTGGTTGTTTGTTTCAATTCATGTAGCTATTTAAACTGGGAT 2439
161P2B7Av.2      ------------------------------------------------------------
161P2B7Av.3      ------------------------------------------------------------

161P2B7Av.1      ACCTTGGACTAAGCCAGTCTGTATCCCAATTCGCTAGCAAGCCTAAGTTTGTGGGGTTTT 2499
161P2B7Av.2      ------------------------------------------------------------
161P2B7Av.3      ------------------------------------------------------------

161P2B7Av.1      GTTTTTGTTTTTGTTTTACCTTCTAATTTACAAGAAAGAGGAAAAGCTCTTCTAACTGAA 2559
161P2B7Av.2      ------------------------------------------------------------
161P2B7Av.3      ------------------------------------------------------------

161P2B7Av.1      CTTTGGTATGCGGTTGAGCTTTGTAACTATTTGTTCTCCATGAAAACAAAATTATTTATA 2619
161P2B7Av.2      ------------------------------------------------------------
161P2B7Av.3      ------------------------------------------------------------
```

Figure 13j (continued)

```
161P2B7Av.1      TTTGACATATTTTTTTCTAGTGTATTAAGTTATTTTAAACAAAAGATGTTATCTCATGAC 2679
161P2B7Av.2      ------------------------------------------------------------
161P2B7Av.3      ------------------------------------------------------------

161P2B7Av.1      GTGTTGTCAGTACAAAATGTGTCGCCTCCAATTCTGTTAAACCTTTTAAATAAGTGCCAA 2739
161P2B7Av.2      ------------------------------------------------------------
161P2B7Av.3      ------------------------------------------------------------

161P2B7Av.1      GTTATTAATT 2749
161P2B7Av.2      ----------
161P2B7Av.3      ----------
```

Figure 14j Alignment of protein sequences of 161P2B7A transcript variants (SEQ ID NOS: 40, 143, 144).

```
161P2B7Av.1      ------------------------------------------------------------
161P2B7Av.2      ------------------------------------------------------------
161P2B7Av.3      MEELTAFVSKSFDQKVKEKKEAITYREVLESGPLRGAKEPTGCTEAGRDDRSSPAVRAAG 60

161P2B7Av.1      ------------------------------------------------------------
161P2B7Av.2      ------------------------------------------------------------
161P2B7Av.3      GGGGGGGGGGGGGGGGVGGGGAGGGAGGGRSPVRELDMGAAERSREPGSPRLTEVSPEL 120

161P2B7Av.1      ---------MEDEGQTKIKQRRSRTNFTLEQLNELERLFDETHYPDAFMREELSQRLGLS 51
161P2B7Av.2      ---------MEDEGQTKIKQRRSRTNFTLEQLNELERLFDETHYPDAFMREELSQRLGLS 51
161P2B7Av.3      KDRKDDAKGMEDEGQTKIKQRRSRTNFTLEQLNELERLFDETHYPDAFMREELSQRLGLS 180
                          ***************************************************

161P2B7Av.1      EARVQVWFQNRRAKCRKQENQLHKGVLIGAASQFEACRVAPYVNVGALRMPFQQ------ 105
161P2B7Av.2      EARVQVWFQNRRAKCRKQENQLHKGVLIGAASQFEACRVAPYVNVGALRMPFQQ------ 105
161P2B7Av.3      EARVQVWFQNRRAKCRKQENQLHKGVLIGAASQFEACRVAPYVNVGALRMPFQQDSHCNV 240
                 ******************************************************

161P2B7Av.1      ------VQAQLQLDSAVAHAHHHLHPHLAAHAPYMMFPAPPFGLPLATLAADSASAASVV 159
```

Figure 14j (continued)

```
161P2B7Av.2      ------VQAQLQLDSAVAHAHHHLHPHLAAHAPYMMFPAPPFGLPLATLAADSASAASVV 159
161P2B7Av.3      TPLPFQVQAQLQLDSAVAHAHHHLHPHLAAHAPYMMFPAPPFGLPLATLAADSASAASVV 300
                       ******************************************************

161P2B7Av.1      AAAAAAKTTSKNSSIADLRLKAKKHAAALGL 190
161P2B7Av.2      AAAAAAKTTSKDSSIADLRLKAKKHAAALGL 190
161P2B7Av.3      AAAAAAKTTSKDSSIADLRLKAKKHAAALGL 331
                 ***********:*******************
```

Figure 11k Nucleotide sequences of transcript variants of 179P3G7

>179P3G7 v.2 (SEQ ID NO:145).

```
cggatgggga aaaaaaaaga tgtcagctcc tccgctgtag tattgctcct taaaaacccc     60
tctctctgaa aatgacatgc cctcgcaatg taactccgaa ctcgtacgcg gagcccttgg    120
ctgcgcccgg cggaggagag cgctatagcc ggagcgcagg catgtatatg cagtctggga    180
gtgacttcaa ttgcggggtg atgaggggct gcgggctcgc cccctcgctc tccaagaggg    240
acgagggcag cagccccagc ctcgccctca acacctatcc gtcctacctc tcgcagctgg    300
actcctgggg cgaccccaaa gccgcctatc gcctggaaca acctgttggc aggccgctgt    360
cctcctgctc ctacccacct agtgtcaagg aggagaatgt ctgctgcatg tacagcgcag    420
agaaccgggc gaaaagtggc cctgaggcag ctctctactc ccaccccttg ccggagtcct    480
gccttgggga gcacgaggta cccgtcccca gctactaccg cgccagcccg agctactccg    540
cgctggacaa gacgccccac tgttctgggg ccaacgactt cgaagcccct ttcgagcagc    600
gggccagtct caacccgcgc gccgaacatc tggaatcgcc tcagctgggg ggcaaagtga    660
gtttccctga gacccccaag tccgacagcc agacccccag ccccaatgaa atcaagacgg    720
agcagagcct ggcgggccct aaagggagcc cctcggagag cgaaaaggag agggccaaag    780
ctgccgactc cagcccagac acctcggata acgaagcgaa aggtaaggcc gcctgggccg    840
cggggcgcac tgggacgttc cggcacttgg tcttcgcggc cggggagggg ggcaggggag    900
agggttgggc ccaggaggcc ccagaccatt tcgggaatgc gaccctggct ttcgactagc    960
gtccgctgag ctccaggctg gtggcgcgtc acttagctgg ggaagaggag ataaaggcag   1020
aaaacaccac aggaaattgg ctgactgcaa agagcggaag gaagaagagg tgcccctata   1080
ctaaacacca gacgctggaa ttggagaaag aatttctgtt caatatgtat ttgacgcgag   1140
agcgccgcct ggagattagc aagaccatta accttacaga cagacaagtc aaaatctggt   1200
ttcaaaatcg cagaatgaaa ctcaagaaaa tgaaccgaga gaatcggatc cgggaactga   1260
cctccaattt taatttcacc tgagagcgcg gcctctcctc ctcccttccc gctccttgct   1320
ctccccgccc ctcctccctt tgtgcctggt gatatatttt tttttcctcc ctgagtataa   1380
atgcaatgcg actgcaaaaa aggcaaagac ctcagactct ccttccaagg gacctgtggt   1440
tcgtgctgcg aagatgcttc cacttaaagc atgagaaatg ggtgccgggg atgtggggtg   1500
tggtgtgtgc cctcatagat gggggtggga gtgtggctgg tgtgtgtgtc aaaccctcac   1560
tcacccacgc actcacacac agcattctgt tctccatgca aagttaagat cgaatccatc   1620
```

Figure 11k (continued)

```
cgcttgtagg ggaaaaaaag gaaaaaaatt aaccagagag ggtctgtaat ctcgcagagc    1680
acaggcagaa tcgttccttc cttgctgcat ttcctcctta gactaataga cgttttggaa    1740
agttcggcta gtgttcgtgt gtttgtcgta gcacccagag cctccaccaa accctctcca    1800
tgtctttacc tcccagtcgc tctaagatct gcttgaagtc tcgtatttgt actgctttct    1860
gcttttctcc cacccctcct agcaccccca catcccccat ctagtaacat ctcagaaatt    1920
tcatccagag gaacaaaaaa attaaaaata gaacatagca aagcaaagac agaatgcccc    1980
cccccaaata ttgtcctgtc cctgtctggg agttgtgtta tttaaagata ttctgtatgt    2040
tgtatctttt gcatgtagct tccttaatgg agaaaaaaaa atcctaataa atttccagaa    2100
tca                                                                  2103
```

Figure 12k Protein sequences of transcript variants of 179P3G7

```
>179P3G7 v.2 (SEQ ID NO 146)
MTCPRNVTPN SYAEPLAAPG GGERYSRSAG MYMQSGSDFN CGVMRGCGLA PSLSKRDEGS      60
SPSLALNTYP SYLSQLDSWG DPKAAYRLEQ PVGRPLSSCS YPPSVKEENV CCMYSAENRA     120
KSGPEAALYS HPLPESCLGE HEVPVPSYYR ASPSYSALDK TPHCSGANDF EAPFEQRASL     180
NPRAEHLESP QLGGKVSFPE TPKSDSQTPS PNEIKTEQSL AGPKGSPSES EKERAKAADS     240
SPDTSDNEAK GKAAWAAGAT GTFRHLVFAA GEGGRGEGWA QEAPDHFGNA TLAFD          295
```

Figure 13k Alignment of nucleotide sequences of 179P3G7 transcript variants
(SEQ ID NOS 41, 145).

```
179P3G7v.1      CGGATGGGGAAAAAAAAAGATGTCAGCTCCTCCGCTGTAGTATTGCTCCTTAAAAACCCC 60
179P3G7v.2      CGGATGGGGAAAAAAAAAGATGTCAGCTCCTCCGCTGTAGTATTGCTCCTTAAAAACCCC 60
                ************************************************************

179P3G7v.1      TCTCTCTGAAAATGACATGCCCTCGCAATGTAACTCCGAACTCGTACGCGGAGCCCTTGG 120
179P3G7v.2      TCTCTCTGAAAATGACATGCCCTCGCAATGTAACTCCGAACTCGTACGCGGAGCCCTTGG 120
                ************************************************************

179P3G7v.1      CTGCGCCCGGCGGAGGAGAGCGCTATAGCCGGAGCGCAGGCATGTATATGCAGTCTGGGA 180
179P3G7v.2      CTGCGCCCGGCGGAGGAGAGCGCTATAGCCGGAGCGCAGGCATGTATATGCAGTCTGGGA 180
                ************************************************************

179P3G7v.1      GTGACTTCAATTGCGGGGTGATGAGGGGCTGCGGGCTCGCCCCCTCGCTCTCCAAGAGGG 240
179P3G7v.2      GTGACTTCAATTGCGGGGTGATGAGGGGCTGCGGGCTCGCCCCCTCGCTCTCCAAGAGGG 240
                ************************************************************

179P3G7v.1      ACGAGGGCAGCAGCCCCAGCCTCGCCCTCAACACCTATCCGTCCTACCTCTCGCAGCTGG 300
```

Figure 13k (continued)

```
179P3G7v.2      ACGAGGGCAGCAGCCCCAGCCTCGCCCTCAACACCTATCCGTCCTACCTCTCGCAGCTGG 300
                ************************************************************

179P3G7v.1      ACTCCTGGGGCGACCCCAAAGCCGCCTATCGCCTGGAACAACCTGTTGGCAGGCCGCTGT 360
179P3G7v.2      ACTCCTGGGGCGACCCCAAAGCCGCCTATCGCCTGGAACAACCTGTTGGCAGGCCGCTGT 360
                ************************************************************

179P3G7v.1      CCTCCTGCTCCTACCCACCTAGTGTCAAGGAGGAGAATGTCTGCTGCATGTACAGCGCAG 420
179P3G7v.2      CCTCCTGCTCCTACCCACCTAGTGTCAAGGAGGAGAATGTCTGCTGCATGTACAGCGCAG 420
                ************************************************************

179P3G7v.1      AGAACCGGGCGAAAAGTGGCCCTGAGGCAGCTCTCTACTCCCACCCCTTGCCGGAGTCCT 480
179P3G7v.2      AGAACCGGGCGAAAAGTGGCCCTGAGGCAGCTCTCTACTCCCACCCCTTGCCGGAGTCCT 480
                ************************************************************

179P3G7v.1      GCCTTGGGGAGCACGAGGTACCCGTCCCCAGCTACTACCGCGCCAGCCCGAGCTACTCCG 540
179P3G7v.2      GCCTTGGGGAGCACGAGGTACCCGTCCCCAGCTACTACCGCGCCAGCCCGAGCTACTCCG 540
                ************************************************************

179P3G7v.1      CGCTGGACAAGACGCCCCACTGTTCTGGGGCCAACGACTTCGAAGCCCCTTTCGAGCAGC 600
179P3G7v.2      CGCTGGACAAGACGCCCCACTGTTCTGGGGCCAACGACTTCGAAGCCCCTTTCGAGCAGC 600
                ************************************************************

179P3G7v.1      GGGCCAGTCTCAACCCGCGCGCCGAACATCTGGAATCGCCTCAGCTGGGGGGCAAAGTGA 660
179P3G7v.2      GGGCCAGTCTCAACCCGCGCGCCGAACATCTGGAATCGCCTCAGCTGGGGGGCAAAGTGA 660
                ************************************************************

179P3G7v.1      GTTTCCCTGAGACCCCCAAGTCCGACAGCCAGACCCCCAGCCCCAATGAAATCAAGACGG 720
179P3G7v.2      GTTTCCCTGAGACCCCCAAGTCCGACAGCCAGACCCCCAGCCCCAATGAAATCAAGACGG 720
                ************************************************************

179P3G7v.1      AGCAGAGCCTGGCGGGCCCTAAAGGGAGCCCCTCGGAGAGCGAAAAGGAGAGGGCCAAAG 780
179P3G7v.2      AGCAGAGCCTGGCGGGCCCTAAAGGGAGCCCCTCGGAGAGCGAAAAGGAGAGGGCCAAAG 780
                ************************************************************

179P3G7v.1      CTGCCGACTCCAGCCCAGACACCTCGGATAACGAAGCGAAAG------------------ 822
179P3G7v.2      CTGCCGACTCCAGCCCAGACACCTCGGATAACGAAGCGAAAGGTAAGGCCGCCTGGGCCG 840
                ******************************************
```

Figure 13k (continued)

```
179P3G7v.1      ------------------------------------------------------------
179P3G7v.2      CGGGCGCCACTGGGACGTTCCGGCACTTGGTCTTCGCGGCCGGGGAGGGGGGCAGGGGAG 900

179P3G7v.1      ------------------------------------------------------------
179P3G7v.2      AGGGTTGGGCCCAGGAGGCCCCAGACCATTTCGGGAATGCGACCCTGGCTTTCGACTAGC 960

179P3G7v.1      ---------------------------------------------AGGAGATAAAGGCAG 837
179P3G7v.2      GTCCGCTGAGCTCCAGGCTGGTGGCGCGTCACTTAGCTGGGGAAGAGGAGATAAAGGCAG 1020
                                                             ***************

179P3G7v.1      AAAACACCACAGGAAATTGGCTGACTGCAAAGAGCGGAAGGAAGAAGAGGTGCCCCTATA 897
179P3G7v.2      AAAACACCACAGGAAATTGGCTGACTGCAAAGAGCGGAAGGAAGAAGAGGTGCCCCTATA 1080
                ************************************************************

179P3G7v.1      CTAAACACCAGACGCTGGAATTGGAGAAAGAATTTCTGTTCAATATGTATTTGACGCGAG 957
179P3G7v.2      CTAAACACCAGACGCTGGAATTGGAGAAAGAATTTCTGTTCAATATGTATTTGACGCGAG 1140
                ************************************************************

179P3G7v.1      AGCGCCGCCTGGAGATTAGCAAGACCATTAACCTTACAGACAGACAAGTCAAAATCTGGT 1017
179P3G7v.2      AGCGCCGCCTGGAGATTAGCAAGACCATTAACCTTACAGACAGACAAGTCAAAATCTGGT 1200
                ************************************************************

179P3G7v.1      TTCAAAATCGCAGAATGAAACTCAAGAAAATGAACCGAGAGAATCGGATCCGGGAACTGA 1077
179P3G7v.2      TTCAAAATCGCAGAATGAAACTCAAGAAAATGAACCGAGAGAATCGGATCCGGGAACTGA 1260
                ************************************************************

179P3G7v.1      CCTCCAATTTTAATTTCACCTGAGAGCGCGGCCTCTCCTCCTCCCTTCCCGCTCCTTGCT 1137
179P3G7v.2      CCTCCAATTTTAATTTCACCTGAGAGCGCGGCCTCTCCTCCTCCCTTCCCGCTCCTTGCT 1320
                ************************************************************

179P3G7v.1      CTCCCCGCCCCTCCTCCCTTTGTGCCTGGTGATATATTTTTTTTTCCTCCCTGAGTATAA 1197
179P3G7v.2      CTCCCCGCCCCTCCTCCCTTTGTGCCTGGTGATATATTTTTTTTTCCTCCCTGAGTATAA 1380
                ************************************************************

179P3G7v.1      ATGCAATGCGACTGCAAAAAAGGCAAAGACCTCAGACTCTCCTTCCAAGGGACCTGTGGT 1257
179P3G7v.2      ATGCAATGCGACTGCAAAAAAGGCAAAGACCTCAGACTCTCCTTCCAAGGGACCTGTGGT 1440
                ************************************************************
```

Figure 13k (continued)

```
179P3G7v.1      TCGTGCTGCGAAGATGCTTCCACTTAAAGCATGAGAAATGGGGTGCCGGGATGTGGGGTG 1317
179P3G7v.2      TCGTGCTGCGAAGATGCTTCCACTTAAAGCATGAGAAATGGGGTGCCGGGATGTGGGGTG 1500
                ************************************************************

179P3G7v.1      TGGTGTGTGCCCTCATAGATGGGGGTGGGAGTGTGGCTGGTGTGTGTGTCAAACCCTCAC 1377
179P3G7v.2      TGGTGTGTGCCCTCATAGATGGGGGTGGGAGTGTGGCTGGTGTGTGTGTCAAACCCTCAC 1560
                ************************************************************

179P3G7v.1      TCACCCACGCACTCACACACAGCATTCTGTTCTCCATGCAAAGTTAAGATCGAATCCATC 1437
179P3G7v.2      TCACCCACGCACTCACACACAGCATTCTGTTCTCCATGCAAAGTTAAGATCGAATCCATC 1620
                ************************************************************

179P3G7v.1      CGCTTGTAGGGGAAAAAAAGGAAAAAAATTAACCAGAGAGGGTCTGTAATCTCGCAGAGC 1497
179P3G7v.2      CGCTTGTAGGGGAAAAAAAGGAAAAAAATTAACCAGAGAGGGTCTGTAATCTCGCAGAGC 1680
                ************************************************************

179P3G7v.1      ACAGGCAGAATCGTTCCTTCCTTGCTGCATTTCCTCCTTAGACTAATAGACGTTTTGGAA 1557
179P3G7v.2      ACAGGCAGAATCGTTCCTTCCTTGCTGCATTTCCTCCTTAGACTAATAGACGTTTTGGAA 1740
                ************************************************************

179P3G7v.1      AGTTCGGCTAGTGTTCGTGTGTTTGTCGTAGCACCCAGAGCCTCCACCAAACCCTCTCCA 1617
179P3G7v.2      AGTTCGGCTAGTGTTCGTGTGTTTGTCGTAGCACCCAGAGCCTCCACCAAACCCTCTCCA 1800
                ************************************************************

179P3G7v.1      TGTCTTTACCTCCCAGTCGCTCTAAGATCTGCTTGAAGTCTCGTATTTGTACTGCTTTCT 1677
179P3G7v.2      TGTCTTTACCTCCCAGTCGCTCTAAGATCTGCTTGAAGTCTCGTATTTGTACTGCTTTCT 1860
                ************************************************************

179P3G7v.1      GCTTTTCTCCCACCCCTCCTAGCACCCCCACATCCCCCATCTAGTAACATCTCAGAAATT 1737
179P3G7v.2      GCTTTTCTCCCACCCCTCCTAGCACCCCCACATCCCCCATCTAGTAACATCTCAGAAATT 1920
                ************************************************************

179P3G7v.1      TCATCCAGAGGAACAAAAAAATTAAAAATAGAACATAGCAAAGCAAAGACAGAATGCCCC 1797
179P3G7v.2      TCATCCAGAGGAACAAAAAAATTAAAAATAGAACATAGCAAAGCAAAGACAGAATGCCCC 1980
                ************************************************************

179P3G7v.1      CCCCCAAATATTGTCCTGTCCCTGTCTGGGAGTTGTGTTATTTAAAGATATTCTGTATGT 1857
179P3G7v.2      CCCCCAAATATTGTCCTGTCCCTGTCTGGGAGTTGTGTTATTTAAAGATATTCTGTATGT 2040
                ************************************************************
```

Figure 13k (continued)

```
179P3G7v.1      TGTATCTTTTGCATGTAGCTTCCTTAATGGAGAAAAAAAAATCCTAATAAATTTCCAGAA 1917
179P3G7v.2      TGTATCTTTTGCATGTAGCTTCCTTAATGGAGAAAAAAAAATCCTAATAAATTTCCAGAA 2100
                ************************************************************

179P3G7v.1      TCATAAAAAAAAAAAAAAAAAAAA 1941
179P3G7v.2      TCA--------------------- 2103
                ***
```

Figure 14k Alignment of protein sequences of 179P3G7 transcript variants (SEQ ID NOS:42, 146).

```
179P3G7v.1      MTCPRNVTPNSYAEPLAAPGGGERYSRSAGMYMQSGSDFNCGVMRGCGLAPSLSKRDEGS 60
179P3G7v.2      MTCPRNVTPNSYAEPLAAPGGGERYSRSAGMYMQSGSDFNCGVMRGCGLAPSLSKRDEGS 60
                ************************************************************

179P3G7v.1      SPSLALNTYPSYLSQLDSWGDPKAAYRLEQPVGRPLSSCSYPPSVKEENVCCMYSAENRA 120
179P3G7v.2      SPSLALNTYPSYLSQLDSWGDPKAAYRLEQPVGRPLSSCSYPPSVKEENVCCMYSAENRA 120
                ************************************************************

179P3G7v.1      KSGPEAALYSHPLPESCLGEHEVPVPSYYRASPSYSALDKTPHCSGANDFEAPFEQRASL 180
179P3G7v.2      KSGPEAALYSHPLPESCLGEHEVPVPSYYRASPSYSALDKTPHCSGANDFEAPFEQRASL 180
                ************************************************************

179P3G7v.1      NPRAEHLESPQLGGKVSFPETPKSDSQTPSPNEIKTEQSLAGPKGSPSESEKERAKAADS 240
179P3G7v.2      NPRAEHLESPQLGGKVSFPETPKSDSQTPSPNEIKTEQSLAGPKGSPSESEKERAKAADS 240
                ************************************************************

179P3G7v.1      SPDTSDNEAKEEIKAENTTGNWLTAKSGRKKRCPYTKHQTLELEKEFLFNMYLTRERRLE 300
179P3G7v.2      SPDTSDNEAKG-------KAAWAAGATG-----------------TFRHLVFAAGE---- 272
                **********        .. * :. :*                  * . :: : *

179P3G7v.1      ISKTINLTDRQVKIWFQNRRMKLKKMNRENRIRELTSNFNFT 342
179P3G7v.2      --------GGRGEGWAQ---------EAPDHFGNATLAFD-- 295
                        . : : * *         : ::: : *  *:
```

Figure 11m Nucleotide sequences of transcript variants of 184P3G10

>184P3G10 v.2 (SEQ ID NO:147).

```
gactacgtgg gtctggagct gactgccgtc ctgacacgtc ctagagctgc aagcaggtcc      60
tgccagagag ccaccatgac ctctcagcct ctcaggctag cagaagagta tggcccaagt     120
cctggggagt ctgaactggc tgtgaacccc tttgatgggc ttcccttctc ttcccgctac     180
tatgagctgc tgaagcagcg ccaagccttg cccatctggg ctgctcgctt taccttcttg     240
gagcagttgg agagtaaccc cactggagtg gtgctggtgt ctggggagcc tggttctggc     300
aagagcaccc agatccctca gtggtgtgca gagtttgcgc tggccagagg gttccagaaa     360
ggacaggtta ctgttactca gccctaccct cttgcagccc ggagcctggc tctgcgggtt     420
gctgatgaga tggacctgac cctgggtcat gaggttggat acagcatccc ccaggaggac     480
tgcacggggc ccaacaccct gctcaggttc tgctgggaca ggctgcttct gcaggaggtg     540
gcctcgaccc gaggcactgg agcctggggc gtgctggtac tagatgaggc tcaggagcgg     600
tcggtggcat cagattcact ccaggggcta ctgcaagatg ccaggctgga aaaacttccg     660
ggggacctca gagtggttgt ggttactgac ccagcccttg aacctaagct ccgagctttc     720
tggggcaatc ctcctattgt gcatataccc agagagcctg gtgagagacc ttcccccatc     780
tactgggaca ccatcccacc tgatcgggtg gaagctgcct gccaagcagt gcttgaattg     840
tgtcggaagg agcttccagg agatgtgcta gtgttcctgc ccagtgagga ggaaatttcc     900
ctgtgctgtg aatccttgtc cagggaggta gagtccttgc ttctccaagg gcttccacca     960
cgagtactgc cccttcaccc agactgtgga cgagccgttc aggctgtgta tgaggacatg    1020
gatgcccgaa aggttgtggt cactcactgg ctggctgact tctccttctc cctcccttcc    1080
atccaacatg tcatcgactc aggactggag ctccgaagtg tttacaatcc taggatccga    1140
gcagaattcc aagtgttgag gccaatcagc aagtgtcagg cagaggcaag acgattgcga    1200
gcaagagggt tcccaccagg atcctgcctc tgcctgtatc ctaagtcctt cttagaacta    1260
gaagctccac cattgccaca acccagggtg tgtgaggaga atctgagctc cctggtgtta    1320
ctactaaaaa ggagacagat tgcagagcca ggggagtgtc acttcctgga ccagcctgct    1380
ccagaagcac tgatgcaagc cctggaagat ttagactatc tggcagccct ggatgatgat    1440
ggggacctgt cagatctggg tgtcatacta tcagaattcc ctctggcccc tgagctggcc    1500
aaagccctgc tggcctcatg cgagtttgac tgtgtggacg agatgctcac cctggctgcc    1560
atgctcacag ctgcccctgg gtttacccgt cctccactca gtgcagaaga agctgccctg    1620
cgtcgggccc tggaacacac ggatggtgac cacagttctc tgatccaggt gtatgaagcc    1680
tttatacaaa gtggagcaga tgaggcttgg tgccaggctc gaggtctgaa ttgggcagca    1740
ttgtgccaag cccataaact tcggggagaa ctcctagaac tcatgcaacg aattgaactt    1800
cccttgtccc taccagcctt tggctctgag cagaatcgca gagaccttca gaaagcactg    1860
gtgtcaggat actttctcaa ggtggccaga gacacagacg ggactggaaa ttaccttctc    1920
ctaacccata agcatgtggc ccagctctcc tcatactgct gctaccgaag ccgcagagct    1980
cctgccagac ccccaccatg ggtgctctac cacaatttca ccatatccaa agacaactgc    2040
ctttccattg tttctgagat tcaaccacag atgctggtgg aattggcccc tccatacttc    2100
ctgagtaact tgcctcccag tgagagcaga gaccttctga accagctaag ggaaggaatg    2160
gcagattcta cagcagggag caaatcatcc tcagcccagg agttcagaga tccctgtgtc    2220
ctgcagtgac ctgcctgcct atggaatgga gctgggttca tctcatcaca ttagattatc    2280
cctcagggtg acaccaaagc acccagacag atttagaagc ccaaagttta gggtcaaatg    2340
```

Figure 11m (continued)

```
taaacoctgg aacctgagtc ccaagaaatg gtagactggg aatggaaaga atggggtaaa    2400
ccacagtcta catagggaag gactctttcc ttagccttct cttattgatt ggagagggac    2460
tgacatgctc ctcattctct taactttgcc aaacccattc ttgtactccc ttgtgatcta    2520
taaaagattt ttctatgatg ccaa                                           2544
```

>184P3G10 v.3 (SEQ ID NO:148).

```
ctgatggcga tgaatgaaca ctgcgtttgc tgggaagatg gtgtcggtca ccaaatatga      60
ccttactggc tgctctgcct tctgcaggtc ctgccagaga gccaccatga cctctcagcc     120
tctcaggcta gcagaagagt atggcccaag tcctggggag tctgaactgg ctgtgaaccc     180
ctttgatggg cttccctctc cttcccgcta ctatgagctg ctgaagcagc gccaagcctt     240
gcccatctgg gctgctcgct ttaccttctt ggagcagttg gagagtaacc ccactggagt     300
ggtgctggtg tctggggagc ctggttctgg caagagcacc cagatccctc agtggtgtgc     360
agagtttgcg ctggccagag ggttccagaa aggacaggtt actgttactc agccctaccc     420
tcttgcagcc cggagcctgg ctctgcgggt tgctgatgag atggacctga ccctgggtca     480
tgaggttgga tacagcatcc cccaggagga ctgcacgggg cccaacaccc tgctcaggtt     540
ctgctgggac aggctgcttc tgcaggaggt ggcctcgacc cgaggcactg gagcctgggg     600
cgtgctggta ctagatgagg ctcaggagcg gtcggtggca tcagattcac tccagggggct     660
actgcaagat gccaggctgg aaaaacttcc gggggacctc agagtggttg tggttactga     720
cccagccctt gaacctaagc tccgagcttt ctggggcaat cctcctattg tgcatatacc     780
cagagagcct ggtgagagac cttcccccat ctactgggac accatcccac ctgatcgggt     840
ggaagctgcc tgccaagcag tgcttgaatt gtgtcggaag gagcttccag gagatgtgct     900
agtgttcctg cccagtgagg aggtaaaaaa acaaaacaaa acaaaaaaaa cagcctgcaa     960
aatgagcctg caaaaggagg aaatttccct gtgctgtgaa tccttgtcca gggaggtaga    1020
gtccttgctt ctccaagggc ttccaccacg agtactgccc cttcacccag actgtggacg    1080
agccgttcag gctgtgtatg aggacatgga tgcccgaaag gttgtggtca ctcactggct    1140
ggctgacttc tccttctccc tcccttccat ccaacatgtc atcgactcag gactggagct    1200
ccgaagtgtt tacaatccta ggatccgagc agaattccaa gtgttgaggc caatcagcaa    1260
gtgtcaggca gaggcaagac gattgcgagc aagagggttc ccaccaggat cctgcctctg    1320
cctgtatcct aagtccttct tagaactaga agctccacca ttgccacaac ccagggtgtg    1380
tgaggagaat ctgagctccc tggtgttact actaaaaagg agacagattg cagagccagg    1440
ggagtgtcac ttcctggacc agcctgctcc agaagcactg atgcaagccc tggaagattt    1500
agactatctg gcagccctgg atgatgatgg ggacctgtca gatctgggtg tcatactatc    1560
agaattccct ctggcccctg agctggccaa agccctgctg gcctcatgcg agtttgactg    1620
tgtggacgag atgctcaccc tggctgccat gctcacagct gcccctgggt ttacccgtcc    1680
tccactcagt gcagaagaag ctgccctgcg tcgggccctg gaacacacgg atggtgacca    1740
cagttctctg atccaggtgt atgaagcctt tatacaaagt ggagcagatg aggcttggtg    1800
ccaggctcga ggtctgaatt gggcagcatt gtgccaagcc cataaacttc ggggagaact    1860
cctagaactc atgcaacgaa ttgaacttcc cttgtcccta ccagcctttg gctctgagca    1920
gaatcgcaga gaccttcaga aagcactggt gtcaggatac tttctcaagg tggccagaga    1980
```

Figure 11m (continued)

```
cacagacggg actggaaatt accttctcct aacccataag catgtggccc agctctcctc    2040
atactgctgc taccgaagcc gcagagctcc tgccagaccc ccaccatggg tgctctacca    2100
caatttcacc atatccaaag acaactgcct ttccattgtt tctgagattc aaccacagat    2160
gctggtggaa ttggcccctc catacttcct gagtaacttg cctcccagtg agagcagaga    2220
ccttctgaac cagctaaggg aaggaatggc agattctaca gcagggagca aatcatcctc    2280
agcccaggag ttcagagatc cctgtgtcct gcagtgacct gcctgcctat ggaatggagc    2340
tgggttcatc tcatcacatt agattatccc tcagggtgac accaaagcac ccagacagat    2400
ttagaagccc aaagtttagg gtcaaatgta aaccctggaa cctgagtccc aagaaatggt    2460
agactgggaa tggaaagaat ggggtaaacc acagtctaca tagggaagga ctctttcctt    2520
agccttctct tattgattgg agagggactg acatgctcct cattctctta actttgccaa    2580
acccattctt gtactccctt gtgatctata aaagattttt ctatgatgcc aa            2632
```

>184P3G10 v.4 (SEQ ID NO:149).

```
ctgatggcga tgaatgaaca ctgcgtttgc tgggaagatg gtgtcggtca ccaaatatga      60
ccttactggc tgctctgcct tctgcaggtc ctgccagaga gccaccatga cctctcagcc     120
tctcaggcta gcagaagagt atggcccaag tcctggggag tctgaactgg ctgtgaaccc     180
ctttgatggg cttccctctc cttcccgcta ctatgagctg ctgaagcagc gccaagcctt     240
gcccatctgg gctgctcgct ttaccttctt ggagcagttg gagagtaacc ccactggagt     300
ggtgctggtg tctggggagc ctggttctgg caagagcacc cagatccctc agtggtgtgc     360
agagtttgcg ctggccagag ggttccagaa aggacaggtt actgttactc agccctaccc     420
tcttgcagcc cggagcctgg ctctgcgggt tgctgatgag atggacctga ccctgggtca     480
tgaggttgga tacagcatcc cccaggagga ctgcacgggg cccaacaccc tgctcaggtt     540
ctgctgggac aggctgcttc tgcaggaggt ggcctcgacc cgaggcactg gagcctgggg     600
cgtgctggta ctagatgagg ctcaggagcg gtcggtggca tcagattcac tccaggggct     660
actgcaagat gccaggctgg aaaaacttcc gggggacctc agagtggttg tggttactga     720
cccagccctt gaacctaagc tccgagcttt ctggggcaat cctcctattg tgcatatacc     780
cagagagcct ggtgagagac cttcccccat ctactgggac accatcccac ctgatcgggt     840
ggaagctgcc tgccaagcag tgcttgaatt gtgtcggaag gagcttccag gagatgtgct     900
agtgttcctg cccagtgagg aggaaatttc cctgtgctgt gaatccttgt ccagggaggt     960
agagtccttg cttctccaag ggcttccacc acgagtactg ccccttcacc cagactgtgg    1020
acgagccgtt caggctgtgt atgaggacat ggatgcccga aaggttgtgg tcactcactg    1080
gctggctgac ttctccttct ccctcccttc catccaacat gtcatcgact caggactgga    1140
gctccgaagt gtgagtgaga gagagagata gcggtggggt agtaaagaca gaaatggccc    1200
actctgatct gtcttggcct tggttggggg acgggcaaca ggtttacaat cctaggatcc    1260
gagcagaatt ccaagtgttg aggccaatca gcaagtgtca ggcagaggca agacgattgc    1320
gagcaagagg gttcccacca ggatcctgcc tctgcctgta tcctaagtcc ttcttagaac    1380
tagaagctcc accattgcca caacccaggg tgtgtgagga gaatctgagc tccctggtgt    1440
tactactaaa aaggagacag attgcagagc caggggagtg tcacttcctg gaccagcctg    1500
```

Figure 11m (continued)

```
ctccagaagc actgatgcaa gccctggaag atttagacta tctggcagcc ctggatgatg    1560
atggggacct gtcagatctg ggtgtcatac tatcagaatt ccctctggcc cctgagctgg    1620
ccaaagccct gctggcctca tgcgagtttg actgtgtgga cgagatgctc accctggctg    1680
ccatgctcac agctgcccct gggtttaccc gtcctccact cagtgcagaa gaagctgccc    1740
tgcgtcgggc cctggaacac acggatggtg accacagttc tctgatccag gtgtatgaag    1800
cctttataca aagtggagca gatgaggctt ggtgccaggc tcgaggtctg aattgggcag    1860
cattgtgcca agcccataaa cttcggggag aactcctaga actcatgcaa cgaattgaac    1920
ttcccttgtc cctaccagcc tttggctctg agcagaatcg cagagacctt cagaaagcac    1980
tggtgtcagg atactttctc aaggtggcca gagacacaga cgggactgga aattaccttc    2040
tcctaaccca taagcatgtg gcccagctct cctcatactg ctgctaccga agccgcagag    2100
ctcctgccag accccaccca tgggtgctct accacaattt caccatatcc aaagacaact    2160
gcctttccat tgtttctgag attcaaccac agatgctggt ggaattggcc cctccatact    2220
tcctgagtaa cttgcctccc agtgagagca gagaccttct gaaccagcta agggaaggaa    2280
tggcagattc tacagcaggg agcaaatcat cctcagccca ggagttcaga gatcctgtg     2340
tcctgcagtg acctgcctgc ctatggaatg gagctgggtt catctcatca cattagatta    2400
tccctcaggg tgacaccaaa gcacccagac agatttagaa gcccaaagtt tagggtcaaa    2460
tgtaaaccct ggaacctgag tcccaagaaa tggtagactg ggaatggaaa gaatggggta    2520
aaccacagtc tacatatggga aggactcttt ccttagcctt ctcttattga ttggagaggg   2580
actgacatgc tcctcattct cttaactttg ccaaacccat tcttgtactc ccttgtgatc    2640
tataaaagat ttttctatga tgccaa                                          2666
```

>184P3G10 v.5 (SEQ ID NO:150).

```
ctgatggcga tgaatgaaca ctgcgtttgc tgggaagatg gtgtcggtca ccaaatatga      60
ccttactggc tgctctgcct tctgcaggtc ctgccagaga gccaccatga cctctcagcc     120
tctcaggcta gcagaagagt atggcccaag tcctggggag tctgaactgg ctgtgaaccc     180
ctttgatggg cttcccttct cttcccgcta ctatgagctg ctgaagcagc gccaagcctt     240
gcccatctgg gctgctcgct ttaccttctt ggagcagttg gagagtaacc ccactggagt     300
ggtgctggtg tctggggagc ctggttctgg caagagcacc cagatccctc agtggtgtgc     360
agagtttgcg ctggccagag ggttccagaa aggacaggtt actgttactc agccctaccc     420
tcttgcagcc cggagcctgg ctctgcgggt tgctgatgag atggacctga ccctgggtca     480
tgaggttgga tacagcatcc cccaggagga ctgcacgggg cccaacaccc tgctcaggtt     540
ctgctgggac aggctgcttc tgcaggaggt ggcctcgacc cgaggcactg gagcctgggg     600
cgtgctggta ctagatgagg ctcaggagcg gtcggtggca tcagattcac tccagggggct    660
actgcaagat gccaggctgg aaaaacttcc gggggacctc agagtggttg tggttactga     720
cccagccctt gaacctaagc tccgagcttt ctggggcaat cctcctattg tgcatatacc     780
cagagagcct ggtgagagac cttcccccat ctactgggac accatcccac ctgatcgggt     840
ggaagctgcc tgccaagcag tgcttgaatt gtgtcggaag gagcttccag gagatgtgct     900
agtgttcctg cccagtgagg aggaaatttc cctgtgctgt gaatccttgt ccagggaggt     960
agagtccttg cttctccaag ggcttccacc acgagtactg ccccttcacc cagactgtgg    1020
```

Figure 11m (continued)

```
acgagccgtt caggctgtgt atgaggacat ggatgcccga aaggttgtgg tcactcactg    1080
gctggctgac ttctccttct ccctcccttc catccaacat gtcatcgact caggactgga    1140
gctccgaagt gtttacaatc ctaggatccg agcagaattc caagtgttga ggccaatcag    1200
caagtgtcag gcagaggcaa gacgattgcg agcaagaggg ttcccaccag tggtcttctt    1260
tcccaggtct ttttcccctc aggatcctgc ctctgcctgt atcctaagtc cttcttagaa    1320
ctagaagctc caccattgcc acaacccagg gtgtgtgagg agaatctgag ctccctggtg    1380
ttactactaa aaaggagaca gattgcagag ccaggggagt gtcacttcct ggaccagcct    1440
gctccagaag cactgatgca agccctggaa gatttagact atctggcagc cctggatgat    1500
gatggggacc tgtcagatct gggtgtcata ctatcagaat tccctctggc ccctgagctg    1560
gccaaagccc tgctggcctc atgcgagttt gactgtgtgg acgagatgct caccctggct    1620
gccatgctca cagctgcccc tgggtttacc cgtcctccac tcagtgcaga agaagctgcc    1680
ctgcgtcggg ccctggaaca cacggatggt gaccacagtt ctctgatcca ggtgtatgaa    1740
gcctttatac aaagtggagc agatgaggct tggtgccagg ctcgaggtct gaattgggca    1800
gcattgtgcc aagcccataa acttcgggga gaactcctag aactcatgca acgaattgaa    1860
cttcccttgt ccctaccagc ctttggctct gagcagaatc gcagagacct tcagaaagca    1920
ctggtgtcag gatactttct caaggtggcc agagacacag acgggactgg aaattacctt    1980
ctcctaaccc ataagcatgt ggcccagctc tcctcatact gctgctaccg aagccgcaga    2040
gctcctgcca gacccccacc atgggtgctc taccacaatt tcaccatatc caaagacaac    2100
tgcctttcca ttgtttctga gattcaacca cagatgctgg tggaattggc ccctccatac    2160
ttcctgagta acttgcctcc cagtgagagc agagaccttc tgaaccagct aagggaagga    2220
atggcagatt ctacagcagg gagcaaatca tcctcagccc aggagttcag agatccctgt    2280
gtcctgcagt gacctgcctg cctatggaat ggagctgggt tcatctcatc acattagatt    2340
atccctcagg gtgacaccaa agcacccaga cagatttaga agcccaaagt ttagggtcaa    2400
atgtaaaccc tggaacctga gtcccaagaa atggtagact gggaatggaa agaatggggt    2460
aaaccacagt ctacataggg aaggactctt tccttagcct tctcttattg attggagagg    2520
gactgacatg ctcctcattc tcttaacttt gccaaaccca ttcttgtact cccttgtgat    2580
ctataaaaga tttttctatg atgccaa                                        2607
```

Figure 12m Protein sequences of transcript variants of 184P3G10

>184P3G10 v.2 (SEQ ID NO:151).

```
MTSQPLRLAE EYGPSPGESE LAVNPFDGLP FSSRYYELLK QRQALPIWAA RFTFLEQLES      60
NPTGVVLVSG EPGSGKSTQI PQWCAEFALA RGFQKGQVTV TQPYPLAARS LALRVADEMD     120
LTLGHEVGYS IPQEDCTGPN TLLRFCWDRL LLQEVASTRG TGAWGVLVLD EAQERSVASD     180
SLQGLLQDAR LEKLPGDLRV VVVTDPALEP KLRAFWGNPP IVHIPREPGE RPSPIYWDTI     240
PPDRVEAACQ AVLELCRKEL PGDVLVFLPS EEEISLCCES LSREVESLLL QGLPPRVLPL     300
HPDCGRAVQA VYEDMDARKV VVTHWLADFS FSLPSIQHVI DSGLELRSVY NPRIRAEFQV     360
LRPISKCQAE ARRLRARGFP PGSCLCLYPK SFLELEAPPL PQPRVCEENL SSLVLLLKRR     420
QIAEPGECHF LDQPAPEALM QALEDLDYLA ALDDDGDLSD LGVILSEFPL APELAKALLA     480
```

Figure 12m (continued)

SCEFDCVDEM LTLAAMLTAA PGFTRPPLSA EEAALRRALE HTDGDHSSLI QVYEAFIQSG 540
ADEAWCQARG LNWAALCQAH KLRGELLELM QRIELPLSLP AFGSEQNRRD LQKALVSGYF 600
LKVARDTDGT GNYLLLTHKH VAQLSSYCCY RSRRAPARPP PWVLYHNFTI SKDNCLSIVS 660
EIQPQMLVEL APPYFLSNLP PSESRDLLNQ LREGMADSTA GSKSSSAQEF RDPCVLQ 717

>184P3G10 v.3 (SEQ ID NO:152).
MNTAFAGKMV SVTKYDLTGC SAFCRSCQRA TMTSQPLRLA EEYGPSPGES ELAVNPFDGL 60
PFSSRYYELL KQRQALPIWA ARFTFLEQLE SNPTGVVLVS GEPGSGKSTQ IPQWCAEFAL 120
ARGFQKGQVT VTQPYPLAAR SLALRVADEM DLTLGHEVGY SIPQEDCTGP NTLLRFCWDR 180
LLLQEVASTR GTGAWGVLVL DEAQERSVAS DSLQGLLQDA RLEKLPGDLR VVVVTDPALE 240
PKLRAFWGNP PIVHIPREPG ERPSPIYWDT IPPDRVEAAC QAVLELCRKE LPGDVLVFLP 300
SEEVKKQNKT KKTACKMSLQ KEEISLCCES LSREVESLLL QGLPPRVLPL HPDCGRAVQA 360
VYEDMDARKV VVTHWLADFS FSLPSIQHVI DSGLELRSVY NPRIRAEFQV LRPISKCQAE 420
ARRLRARGFP PGSCLCLYPK SFLELEAPPL PQPRVCEENL SSLVLLLKRR QIAEPGECHF 480
LDQPAPEALM QALEDLDYLA ALDDDGDLSD LGVILSEFPL APELAKALLA SCEFDCVDEM 540
LTLAAMLTAA PGFTRPPLSA EEAALRRALE HTDGDHSSLI QVYEAFIQSG ADEAWCQARG 600
LNWAALCQAH KLRGELLELM QRIELPLSLP AFGSEQNRRD LQKALVSGYF LKVARDTDGT 660
GNYLLLTHKH VAQLSSYCCY RSRRAPARPP PWVLYHNFTI SKDNCLSIVS EIQPQMLVEL 720
APPYFLSNLP PSESRDLLNQ LREGMADSTA GSKSSSAQEF RDPCVLQ 767

>184P3G10 v.4A (SEQ ID NO:153).
MNTAFAGKMV SVTKYDLTGC SAFCRSCQRA TMTSQPLRLA EEYGPSPGES ELAVNPFDGL 60
PFSSRYYELL KQRQALPIWA ARFTFLEQLE SNPTGVVLVS GEPGSGKSTQ IPQWCAEFAL 120
ARGFQKGQVT VTQPYPLAAR SLALRVADEM DLTLGHEVGY SIPQEDCTGP NTLLRFCWDR 180
LLLQEVASTR GTGAWGVLVL DEAQERSVAS DSLQGLLQDA RLEKLPGDLR VVVVTDPALE 240
PKLRAFWGNP PIVHIPREPG ERPSPIYWDT IPPDRVEAAC QAVLELCRKE LPGDVLVFLP 300
SEEEISLCCE SLSREVESLL LQGLPPRVLP LHPDCGRAVQ AVYEDMDARK VVVTHWLADF 360
SFSLPSIQHV IDSGLELRSV SERER 385

>184P3G10 v.4B (SEQ ID NO:154).
MAHSDLSWPW LGDGQQVYNP RIRAEFQVLR PISKCQAEAR RLRARGFPPG SCLCLYPKSF 60
LELEAPPLPQ PRVCEENLSS LVLLLKRRQI AEPGECHFLD QPAPEALMQA LEDLDYLAAL 120
DDDGDLSDLG VILSEFPLAP ELAKALLASC EFDCVDEMLT LAAMLTAAPG FTRPPLSAEE 180
AALRRALEHT DGDHSSLIQV YEAFIQSGAD EAWCQARGLN WAALCQAHKL RGELLELMQR 240
IELPLSLPAF GSEQNRRDLQ KALVSGYFLK VARDTDGTGN YLLLTHKHVA QLSSYCCYRS 300
RRAPARPPPW VLYHNFTISK DNCLSIVSEI QPQMLVELAP PYFLSNLPPS ESRDLLNQLR 360
EGMADSTAGS KSSSAQEFRD PCVLQ 385

Figure 12m (continued)

>184P3G10 v.5A (SEQ ID NO:155).
```
MNTAPAGKMV SVTKYDLTGC SAFCRSCQRA TMTSQPLRLA BRXGPSPGES ELAVNPFDGL    60
PPSSRYYELL KQRQALPIWA ARFTFLEQLE SNFTGVVLVS GEPGSGKSTQ IPQWCAEFAL   120
ARGFQKGQVT VTQPTPLAAR SLALRVADEM DLIIGHEVGT SIPQEDCTGP NTLLRFCWDR   180
LLLQEVASTR GTGAWGVLVL DEAQERSVAS DSLQGLLQDA RLEKLPGDLR VVVVTDPALE   240
PKLRAFWGMP PIVHIERREPG ERPSPIYWDT IPPDKVERAC QAVIELCRKE LPGDVLVFLP   300
SEEEISLCCE SLSREVESLL LQGLPPPVLP LHPDCGRAVQ AVYEDMDARK VVVTHWLADF   360
SPSLPSIQHV IDSGLELRSV YMPRIRAEFQ VLRFISKCQA EARRLRARGF PPVVFFPRSF   420
SPQDPASACI LSPS                                                    434
```

>184P3G10 v.5B (SEQ ID NO:156).
```
MQALEDLDYL AALDDBGDLS DLGVILSEFP LAFELAKALL ASCEFDCVDE MLTLARMLTA    60
APGFTRPPLS AEEAALRRAL EHTDGDHSSL IQVYEAFIQS GAEEAWCQAR GLNWAALCQA   120
HKLRGELLEI MQRIELPLSL PAFGSEQMRR DLQKALVSGY FLKVARGTDG TGNYLLLTHK   180
HVAQLSSYCC YRSRPAPARP FPWVLYHNFI ISKDNCLSIV SEIQPQMLVE LAPPYFLSML   240
PPSESRDLIN QLREGMADST AGSKSSAQE FRDPCVLQ                           278
```

Figure 13m Alignment of nucleotide sequences of 184P3G10 transcript variants
(SEQ ID NOS:45, 147, 148, 149, 150)

```
184P3G10v.1  CTGATGGCGATGAATGAACACTGCGTTTGCTGGGAAGATGGTGTCGGTCACCAAATATGA   60
184P3G10v.2  ------------------------GACTACGTGGCTCTGCCAGCTGCACTGCCGT---CCTGACCACGT   39
184P3G10v.3  CTGATGGCGATGAATGAATGAACACTGCGTTTGCTGGGAAGATGGTGTCGGTCACCAAATATGA   60
184P3G10v.4  CTGATGGCGATGAATGAATGAACACTGCGTTTGCTGGGAAGATGGTGTCGGTCACCAAATATGA   60
184P3G10v.5  CTGATGGCGATGAATGAATGAACACTGCGTTTGCTGGGAAGATGGTGTCGGTCACCAAATATGA   60
                                     *  *  ** ***   **  * * * **  ****

184P3G10v.1  CCTTACTGGCTGCTCTGCCTTCTGCCTTCTGCAGGTCCTGCCAGAGAGCCACCATGACCTCTCAGCC   120
184P3G10v.2  CCTTAG--AGCTGCAA-------GCAGGTCCTGCCAGAGAGCCACCATGACCTCTCAGCC    99
184P3G10v.3  CCTTACTGGCTGCTCTGCCTTCTGCCTTCTGCAGGTCCTGCCAGAGAGCCACCATGACCTCTCAGCC   120
184P3G10v.4  CCTTACTGGCTGCTCTGCCTTCTGCCTTCTGCAGGTCCTGCCAGAGAGCCACCATGACCTCTCAGCC   120
184P3G10v.5  CCTTACTGGCTGCTCTGCCTTCTGCCTTCTGCAGGTCCTGCCAGAGAGCCACCATGACCTCTCAGCC   120
                  *                  ** ********************************

184P3G10v.1  TCTCAGGCTAGCAGAAGAGTATGGCCCAAGTCCTGGGAGTCCTGAACTGGCTGGCTGAACCC   180
184P3G10v.2  TCTCAGGCTAGCAGAAGAGTATGGCCCAAGTCCTGGGAGTCCTGAACTGGCTGGCTGAACCC   149
184P3G10v.3  TCTCAGGCTAGCAGAAGAGTATGGCCCAAGTCCTGGGAGTCCTGAACTGGCTGGCTGAACCC   180
184P3G10v.4  TCTCAGGCTAGCAGAAGAGTATGGCCCAAGTCCTGGGAGTCCTGAACTGGCTGGCTGAACCC   180
184P3G10v.5  TCTCAGGCTAGCAGAAGAGTATGGCCCAAGTCCTGGGAGTCCTGAACTGGCTGGCTGAACCC   180
             ********************************************** ***************
```

```
                    ************************************************************

184P3G10v.1         CTTTGATGGGCTTCCCTTCTCTTCCCGCTACTATGAGCTGCTGAAGCAGCGCCAAGCCTT 240
184P3G10v.2         CTTTGATGGGCTTCCCTTCTCTTCCCGCTACTATGAGCTGCTGAAGCAGCGCCAAGCCTT 209
184P3G10v.3         CTTTGATGGGCTTCCCTTCTCTTCCCGCTACTATGAGCTGCTGAAGCAGCGCCAAGCCTT 240
184P3G10v.4         CTTTGATGGGCTTCCCTTCTCTTCCCGCTACTATGAGCTGCTGAAGCAGCGCCAAGCCTT 240
184P3G10v.5         CTTTGATGGGCTTCCCTTCTCTTCCCGCTACTATGAGCTGCTGAAGCAGCGCCAAGCCTT 240
                    ************************************************************

184P3G10v.1         GCCCATCTGGGCTGCTCGCTTTACCTTCTTGGAGCAGTTGGAGAGTAACCCCACTGGAGT 300
184P3G10v.2         GCCCATCTGGGCTGCTCGCTTTACCTTCTTGGAGCAGTTGGAGAGTAACCCCACTGGAGT 269
184P3G10v.3         GCCCATCTGGGCTGCTCGCTTTACCTTCTTGGAGCAGTTGGAGAGTAACCCCACTGGAGT 300
184P3G10v.4         GCCCATCTGGGCTGCTCGCTTTACCTTCTTGGAGCAGTTGGAGAGTAACCCCACTGGAGT 300
184P3G10v.5         GCCCATCTGGGCTGCTCGCTTTACCTTCTTGGAGCAGTTGGAGAGTAACCCCACTGGAGT 300
                    ************************************************************

184P3G10v.1         GGTGCTGGTGTCTGGGGAGCCTGGTTCTGGCAAGAGCACCCAGATCCCTCAGTGGTGTGC 360
184P3G10v.2         GGTGCTGGTGTCTGGGGAGCCTGGTTCTGGCAAGAGCACCCAGATCCCTCAGTGGTGTGC 329
184P3G10v.3         GGTGCTGGTGTCTGGGGAGCCTGGTTCTGGCAAGAGCACCCAGATCCCTCAGTGGTGTGC 360
184P3G10v.4         GGTGCTGGTGTCTGGGGAGCCTGGTTCTGGCAAGAGCACCCAGATCCCTCAGTGGTGTGC 360
184P3G10v.5         GGTGCTGGTGTCTGGGGAGCCTGGTTCTGGCAAGAGCACCCAGATCCCTCAGTGGTGTGC 360
                    ************************************************************

184P3G10v.1         AGAGTTTGCGCTGGCCAGAGGGTTCCAGAAAGGACAGGTTACTGTTACTCAGCCCTACCC 420
184P3G10v.2         AGAGTTTGCGCTGGCCAGAGGGTTCCAGAAAGGACAGGTTACTGTTACTCAGCCCTACCC 389
184P3G10v.3         AGAGTTTGCGCTGGCCAGAGGGTTCCAGAAAGGACAGGTTACTGTTACTCAGCCCTACCC 420
184P3G10v.4         AGAGTTTGCGCTGGCCAGAGGGTTCCAGAAAGGACAGGTTACTGTTACTCAGCCCTACCC 420
184P3G10v.5         AGAGTTTGCGCTGGCCAGAGGGTTCCAGAAAGGACAGGTTACTGTTACTCAGCCCTACCC 420
                    ************************************************************

184P3G10v.1         TCTTGCAGCCCGGAGCCTGGCTCTGCGGGTTGCTGATGAGATGGACCTGACCCTGGGTCA 480
184P3G10v.2         TCTTGCAGCCCGGAGCCTGGCTCTGCGGGTTGCTGATGAGATGGACCTGACCCTGGGTCA 449
184P3G10v.3         TCTTGCAGCCCGGAGCCTGGCTCTGCGGGTTGCTGATGAGATGGACCTGACCCTGGGTCA 480
184P3G10v.4         TCTTGCAGCCCGGAGCCTGGCTCTGCGGGTTGCTGATGAGATGGACCTGACCCTGGGTCA 480
184P3G10v.5         TCTTGCAGCCCGGAGCCTGGCTCTGCGGGTTGCTGATGAGATGGACCTGACCCTGGGTCA 480
                    ************************************************************

184P3G10v.1         TGAGGTTGGATACAGCATCCCCCAGGAGGACTGCACGGGGCCCAACACCCTGCTCAGGTT 540
184P3G10v.2         TGAGGTTGGATACAGCATCCCCCAGGAGGACTGCACGGGGCCCAACACCCTGCTCAGGTT 509
```

Figure 13m (continued)

```
184P3G10v.3      TGAGGTTGGATACAGCATCCCCCAGGAGGACTGCACGGGGCCCAACACCCTGCTCAGGTT 540
184P3G10v.4      TGAGGTTGGATACAGCATCCCCCAGGAGGACTGCACGGGGCCCAACACCCTGCTCAGGTT 540
184P3G10v.5      TGAGGTTGGATACAGCATCCCCCAGGAGGACTGCACGGGGCCCAACACCCTGCTCAGGTT 540
                 ************************************************************

184P3G10v.1      CTGCTGGGACAGGCTGCTTCTGCAGGAGGTGGCCTCGACCCGAGGCACTGGAGCCTGGGG 600
184P3G10v.2      CTGCTGGGACAGGCTGCTTCTGCAGGAGGTGGCCTCGACCCGAGGCACTGGAGCCTGGGG 569
184P3G10v.3      CTGCTGGGACAGGCTGCTTCTGCAGGAGGTGGCCTCGACCCGAGGCACTGGAGCCTGGGG 600
184P3G10v.4      CTGCTGGGACAGGCTGCTTCTGCAGGAGGTGGCCTCGACCCGAGGCACTGGAGCCTGGGG 600
184P3G10v.5      CTGCTGGGACAGGCTGCTTCTGCAGGAGGTGGCCTCGACCCGAGGCACTGGAGCCTGGGG 600
                 ************************************************************

184P3G10v.1      CGTGCTGGTACTAGATGAGGCTCAGGAGCGGTCGGTGGCATCAGATTCACTCCAGGGGCT 660
184P3G10v.2      CGTGCTGGTACTAGATGAGGCTCAGGAGCGGTCGGTGGCATCAGATTCACTCCAGGGGCT 629
184P3G10v.3      CGTGCTGGTACTAGATGAGGCTCAGGAGCGGTCGGTGGCATCAGATTCACTCCAGGGGCT 660
184P3G10v.4      CGTGCTGGTACTAGATGAGGCTCAGGAGCGGTCGGTGGCATCAGATTCACTCCAGGGGCT 660
184P3G10v.5      CGTGCTGGTACTAGATGAGGCTCAGGAGCGGTCGGTGGCATCAGATTCACTCCAGGGGCT 660
                 ************************************************************

184P3G10v.1      ACTGCAAGATGCCAGGCTGGAAAAACTTCCGGGGGACCTCAGAGTGGTTGTGGTTACTGA 720
184P3G10v.2      ACTGCAAGATGCCAGGCTGGAAAAACTTCCGGGGGACCTCAGAGTGGTTGTGGTTACTGA 689
184P3G10v.3      ACTGCAAGATGCCAGGCTGGAAAAACTTCCGGGGGACCTCAGAGTGGTTGTGGTTACTGA 720
184P3G10v.4      ACTGCAAGATGCCAGGCTGGAAAAACTTCCGGGGGACCTCAGAGTGGTTGTGGTTACTGA 720
184P3G10v.5      ACTGCAAGATGCCAGGCTGGAAAAACTTCCGGGGGACCTCAGAGTGGTTGTGGTTACTGA 720
                 ************************************************************

184P3G10v.1      CCCAGCCCTTGAACCTAAGCTCCGAGCTTTCTGGGGCAATCCTCCTATTGTGCATATACC 780
184P3G10v.2      CCCAGCCCTTGAACCTAAGCTCCGAGCTTTCTGGGGCAATCCTCCTATTGTGCATATACC 749
184P3G10v.3      CCCAGCCCTTGAACCTAAGCTCCGAGCTTTCTGGGGCAATCCTCCTATTGTGCATATACC 780
184P3G10v.4      CCCAGCCCTTGAACCTAAGCTCCGAGCTTTCTGGGGCAATCCTCCTATTGTGCATATACC 780
184P3G10v.5      CCCAGCCCTTGAACCTAAGCTCCGAGCTTTCTGGGGCAATCCTCCTATTGTGCATATACC 780
                 ************************************************************

184P3G10v.1      CAGAGAGCCTGGTGAGAGACCTTCCCCCATCTACTGGGACACCATCCCACCTGATCGGGT 840
184P3G10v.2      CAGAGAGCCTGGTGAGAGACCTTCCCCCATCTACTGGGACACCATCCCACCTGATCGGGT 809
184P3G10v.3      CAGAGAGCCTGGTGAGAGACCTTCCCCCATCTACTGGGACACCATCCCACCTGATCGGGT 840
184P3G10v.4      CAGAGAGCCTGGTGAGAGACCTTCCCCCATCTACTGGGACACCATCCCACCTGATCGGGT 840
184P3G10v.5      CAGAGAGCCTGGTGAGAGACCTTCCCCCATCTACTGGGACACCATCCCACCTGATCGGGT 840
                 ************************************************************
```

Figure 13m (continued)

```
184P3G10v.1      GGAAGCTGCCTGCCAAGCAGTGCTTGAATTGTGTCGGAAGGAGCTTCCAGGAGATGTGCT 900
184P3G10v.2      GGAAGCTGCCTGCCAAGCAGTGCTTGAATTGTGTCGGAAGGAGCTTCCAGGAGATGTGCT 869
184P3G10v.3      GGAAGCTGCCTGCCAAGCAGTGCTTGAATTGTGTCGGAAGGAGCTTCCAGGAGATGTGCT 900
184P3G10v.4      GGAAGCTGCCTGCCAAGCAGTGCTTGAATTGTGTCGGAAGGAGCTTCCAGGAGATGTGCT 900
184P3G10v.5      GGAAGCTGCCTGCCAAGCAGTGCTTGAATTGTGTCGGAAGGAGCTTCCAGGAGATGTGCT 900
                 ************************************************************

184P3G10v.1      AGTGTTCCTGCCCAGTGAGGAGG------------------------------------- 923
184P3G10v.2      AGTGTTCCTGCCCAGTGAGGAGG------------------------------------- 892
184P3G10v.3      AGTGTTCCTGCCCAGTGAGGAGGTAAAAAAACAAAACAAAACAAAAAAAACAGCCTGCAA 960
184P3G10v.4      AGTGTTCCTGCCCAGTGAGGAGG------------------------------------- 923
184P3G10v.5      AGTGTTCCTGCCCAGTGAGGAGG------------------------------------- 923
                 ***********************

184P3G10v.1      --------------------AAATTTCCCTGTGCTGTGAATCCTTGTCCAGGGAGGTAGA 963
184P3G10v.2      --------------------AAATTTCCCTGTGCTGTGAATCCTTGTCCAGGGAGGTAGA 932
184P3G10v.3      AATGAGCCTGCAAAAGGAGGAAATTTCCCTGTGCTGTGAATCCTTGTCCAGGGAGGTAGA 1020
184P3G10v.4      --------------------AAATTTCCCTGTGCTGTGAATCCTTGTCCAGGGAGGTAGA 963
184P3G10v.5      --------------------AAATTTCCCTGTGCTGTGAATCCTTGTCCAGGGAGGTAGA 963
                                     ****************************************

184P3G10v.1      GTCCTTGCTTCTCCAAGGGCTTCCACCACGAGTACTGCCCCTTCACCCAGACTGTGGACG 1023
184P3G10v.2      GTCCTTGCTTCTCCAAGGGCTTCCACCACGAGTACTGCCCCTTCACCCAGACTGTGGACG 992
184P3G10v.3      GTCCTTGCTTCTCCAAGGGCTTCCACCACGAGTACTGCCCCTTCACCCAGACTGTGGACG 1080
184P3G10v.4      GTCCTTGCTTCTCCAAGGGCTTCCACCACGAGTACTGCCCCTTCACCCAGACTGTGGACG 1023
184P3G10v.5      GTCCTTGCTTCTCCAAGGGCTTCCACCACGAGTACTGCCCCTTCACCCAGACTGTGGACG 1023
                 ************************************************************

184P3G10v.1      AGCCGTTCAGGCTGTGTATGAGGACATGGATGCCCGAAAGGTTGTGGTCACTCACTGGCT 1083
184P3G10v.2      AGCCGTTCAGGCTGTGTATGAGGACATGGATGCCCGAAAGGTTGTGGTCACTCACTGGCT 1052
184P3G10v.3      AGCCGTTCAGGCTGTGTATGAGGACATGGATGCCCGAAAGGTTGTGGTCACTCACTGGCT 1140
184P3G10v.4      AGCCGTTCAGGCTGTGTATGAGGACATGGATGCCCGAAAGGTTGTGGTCACTCACTGGCT 1083
184P3G10v.5      AGCCGTTCAGGCTGTGTATGAGGACATGGATGCCCGAAAGGTTGTGGTCACTCACTGGCT 1083
                 ************************************************************

184P3G10v.1      GGCTGACTTCTCCTTCTCCCTCCCTTCCATCCAACATGTCATCGACTCAGGACTGGAGCT 1143
184P3G10v.2      GGCTGACTTCTCCTTCTCCCTCCCTTCCATCCAACATGTCATCGACTCAGGACTGGAGCT 1112
184P3G10v.3      GGCTGACTTCTCCTTCTCCCTCCCTTCCATCCAACATGTCATCGACTCAGGACTGGAGCT 1200
184P3G10v.4      GGCTGACTTCTCCTTCTCCCTCCCTTCCATCCAACATGTCATCGACTCAGGACTGGAGCT 1143
```

Figure 13m (continued)

```
184P3G10v.5      GGCTGACTTCTCCTTCTCCCTCCCTTCCATCCAACATGTCATCGACTCAGGACTGGAGCT 1143
                 ************************************************************

184P3G10v.1      CCGAAGTGT--------------------------------------------------- 1152
184P3G10v.2      CCGAAGTGT--------------------------------------------------- 1121
184P3G10v.3      CCGAAGTGT--------------------------------------------------- 1209
184P3G10v.4      CCGAAGTGTGAGTGAGAGAGAGAGATAGCGGTGGGGTAGTAAAGACAGAAATGGCCCACT 1203
184P3G10v.5      CCGAAGTGT--------------------------------------------------- 1152
                 *********

184P3G10v.1      ----------------------------------------TTACAATCCTAGGATCCGAG 1172
184P3G10v.2      ----------------------------------------TTACAATCCTAGGATCCGAG 1141
184P3G10v.3      ----------------------------------------TTACAATCCTAGGATCCGAG 1229
184P3G10v.4      CTGATCTGTCTTGGCCTTGGTTGGGGGACGGGCAACAGGTTTACAATCCTAGGATCCGAG 1263
184P3G10v.5      ----------------------------------------TTACAATCCTAGGATCCGAG 1172
                                                         ********************

184P3G10v.1      CAGAATTCCAAGTGTTGAGGCCAATCAGCAAGTGTCAGGCAGAGGCAAGACGATTGCGAG 1232
184P3G10v.2      CAGAATTCCAAGTGTTGAGGCCAATCAGCAAGTGTCAGGCAGAGGCAAGACGATTGCGAG 1201
184P3G10v.3      CAGAATTCCAAGTGTTGAGGCCAATCAGCAAGTGTCAGGCAGAGGCAAGACGATTGCGAG 1289
184P3G10v.4      CAGAATTCCAAGTGTTGAGGCCAATCAGCAAGTGTCAGGCAGAGGCAAGACGATTGCGAG 1323
184P3G10v.5      CAGAATTCCAAGTGTTGAGGCCAATCAGCAAGTGTCAGGCAGAGGCAAGACGATTGCGAG 1232
                 ************************************************************

184P3G10v.1      CAAGAGGGTTCCCACCAG--------------------------------GATCCTGCCT 1260
184P3G10v.2      CAAGAGGGTTCCCACCAG--------------------------------GATCCTGCCT 1229
184P3G10v.3      CAAGAGGGTTCCCACCAG--------------------------------GATCCTGCCT 1317
184P3G10v.4      CAAGAGGGTTCCCACCAG--------------------------------GATCCTGCCT 1351
184P3G10v.5      CAAGAGGGTTCCCACCAGTGGTCTTCTTTCCCAGGTCTTTTTCCCCTCAGGATCCTGCCT 1292
                 ******************                                **********

184P3G10v.1      CTGCCTGTATCCTAAGTCCTTCTTAGAACTAGAAGCTCCACCATTGCCACAACCCAGGGT 1320
184P3G10v.2      CTGCCTGTATCCTAAGTCCTTCTTAGAACTAGAAGCTCCACCATTGCCACAACCCAGGGT 1289
184P3G10v.3      CTGCCTGTATCCTAAGTCCTTCTTAGAACTAGAAGCTCCACCATTGCCACAACCCAGGGT 1377
184P3G10v.4      CTGCCTGTATCCTAAGTCCTTCTTAGAACTAGAAGCTCCACCATTGCCACAACCCAGGGT 1411
184P3G10v.5      CTGCCTGTATCCTAAGTCCTTCTTAGAACTAGAAGCTCCACCATTGCCACAACCCAGGGT 1352
                 ************************************************************

184P3G10v.1      GTGTGAGGAGAATCTGAGCTCCCTGGTGTTACTACTAAAAAGGAGACAGATTGCAGAGCC 1380
```

Figure 13m (continued)

```
184P3G10v.2   GTGTGAGGAGAGAATTGAGTCCCTGGTGTTACTACTAAAAGGAGACAGATTGCAGAGCC   1349
184P3G10v.3   GTGTGAGGAGAGAATTGAGTCCCTGGTGTTACTACTAAAAGGAGACAGATTGCAGAGCC   1437
184P3G10v.4   GTGTGAGGAGAGAATCGAGTCCCTGGTGTTACTACTAARAAGGAGACAGATTGCAGAGCC   1471
184P3G10v.5   GTGTGAGGAGAGAATCGAGTCCCTGGTGTTACTACTAAAAGGAGACAGATTGCAGAGCC   1412
              ************ *******************  ************************

184P3G10v.1   AGGGGAGTGTCACTTCCTGGACCAGCCTGCTCCAGAAGCACTGATGCAAGCCTGGAAGA   1440
184P3G10v.2   AGGGGAGTGTCACTTCCTGGACCAGCCTGCTCCAGAAGCACTGATGCAAGCCTGGAAGA   1409
184P3G10v.3   AGGGGAGTGTCACTTCCTGGACCAGCCTGCTCCAGAAGCACTGATGCAAGCCTGGAAGA   1497
184P3G10v.4   AGGGGAGTGTCACTTCCTGGACCAGCCTGCTCCAGAAGCACTGATGCAAGCCTGGAAGA   1531
184P3G10v.5   AGGGGAGTGTCACTTCCTGGACCAGCCTGCTCCAGAAGCACTGATGCAAGCCTGGAAGA   1472
              ************************************************************

184P3G10v.1   TTTAGACTATCTGGCAGCCCTGGATGATGATGGGACCTGTCAGATCTGGGTGTCATACT   1500
184P3G10v.2   TTTAGACTATCTGGCAGCCCTGGATGATGATGGGACCTGTCAGATCTGGGTGTCATACT   1469
184P3G10v.3   TTTAGACTATCTGGCAGCCCTGGATGATGATGGGACCTGTCAGATCTGGGTGTCATACT   1557
184P3G10v.4   TTTAGACTATCTGGCAGCCCTGGATGATGATGGGACCTGTCAGATCTGGGTGTCATACT   1591
184P3G10v.5   TTTAGACTATCTGGCAGCCCTGGATGATGATGGGACCTGTCAGATCTGGGTGTCATACT   1532
              ************************************************************

184P3G10v.1   ATCAGAATTCCCTGGCCCCTGAGCTGGCCAAGCCCTGCTGGCCTCATGCGAGTTTTGA   1550
184P3G10v.2   ATCAGAATTCCCTGGCCCCTGAGCTGGCCAAGCCCTGCTGGCCTCATGCGAGTTTTGA   1529
184P3G10v.3   ATCAGAATTCCCTGGCCCCTGAGCTGGCCAAGCCCTGCTGGCCTCATGCGAGTTTTGA   1617
184P3G10v.4   ATCAGAATTCCCTGGCCCCTGAGCTGGCCAAGCCCTGCTGGCCTCATGCGAGTTTTGA   1651
184P3G10v.5   ATCAGAATTCCCTGGCCCCTGAGCTGGCCAAGCCCTGCTGGCCTCATGCGAGTTTTGA   1592
              ************************************************************

184P3G10v.1   CTGTGTGGACGGATGCTCACCCTGGCCATGCTCACAGCTGCCCCTGGTTTACCCG   1620
184P3G10v.2   CTGTGTGGACGGATGCTCACCCTGGCCATGCTCACAGCTGCCCCTGGTTTACCCG   1589
184P3G10v.3   CTGTCTGGACGGAGATGCTCACCCTGGCCATGCTCACAGCTGCCCCTGGTTTACCCG   1677
184P3G10v.4   CTGTCTGGACGAGATGCTCACCCTGGCCATGCTCACAGCTGCCCCTGGTTTACCCG   1711
184P3G10v.5   CTGTGTGGACGAGATGCTCACCCTGGCCATGCTCACAGCTGCCCCTGGTTTACCCG   1652
              ************************************************************

184P3G10v.1   TCCTCCACTCAGTCAGAAGAAGCTGCCCTGGGCCCTGGAACACGGATGGTGA   1680
184P3G10v.2   TCCTCCACTCAGTCAGAAGAAGCTGCCCTGGGCCCTGGAACACGGATGGTGA   1649
184P3G10v.3   TCCTCCACTCAGTCAGAAGAAGCTGCCCTGGGCCCTGGAACACGGATGGTGA   1737
184P3G10v.4   TCCTCCACTCAGTCAGAAGAAGCTGCCCTGGGCCCTGGAACACGGATGGTGA   1771
184P3G10v.5   TCCTCCACTCAGTCAGAAGAAGCTGCCCTGGGCCCTGGAACACGGATGGTGA   1712
              ************************************************************
```

```
                  ************************************************************

184P3G10v.1       CCACAGTTCTCTGATCCAGGTGTATGAAGCCTTTATACAAAGTGGAGCAGATGAGGCTTG 1740
184P3G10v.2       CCACAGTTCTCTGATCCAGGTGTATGAAGCCTTTATACAAAGTGGAGCAGATGAGGCTTG 1709
184P3G10v.3       CCACAGTTCTCTGATCCAGGTGTATGAAGCCTTTATACAAAGTGGAGCAGATGAGGCTTG 1797
184P3G10v.4       CCACAGTTCTCTGATCCAGGTGTATGAAGCCTTTATACAAAGTGGAGCAGATGAGGCTTG 1831
184P3G10v.5       CCACAGTTCTCTGATCCAGGTGTATGAAGCCTTTATACAAAGTGGAGCAGATGAGGCTTG 1772
                  ************************************************************

184P3G10v.1       GTGCCAGGCTCGAGGTCTGAATTGGGCAGCATTGTGCCAAGCCCATAAACTTCGGGGAGA 1800
184P3G10v.2       GTGCCAGGCTCGAGGTCTGAATTGGGCAGCATTGTGCCAAGCCCATAAACTTCGGGGAGA 1769
184P3G10v.3       GTGCCAGGCTCGAGGTCTGAATTGGGCAGCATTGTGCCAAGCCCATAAACTTCGGGGAGA 1857
184P3G10v.4       GTGCCAGGCTCGAGGTCTGAATTGGGCAGCATTGTGCCAAGCCCATAAACTTCGGGGAGA 1891
184P3G10v.5       GTGCCAGGCTCGAGGTCTGAATTGGGCAGCATTGTGCCAAGCCCATAAACTTCGGGGAGA 1832
                  ************************************************************

184P3G10v.1       ACTCCTAGAACTCATGCAACGAATTGAACTTCCCTTGTCCCTACCAGCCTTTGGCTCTGA 1860
184P3G10v.2       ACTCCTAGAACTCATGCAACGAATTGAACTTCCCTTGTCCCTACCAGCCTTTGGCTCTGA 1829
184P3G10v.3       ACTCCTAGAACTCATGCAACGAATTGAACTTCCCTTGTCCCTACCAGCCTTTGGCTCTGA 1917
184P3G10v.4       ACTCCTAGAACTCATGCAACGAATTGAACTTCCCTTGTCCCTACCAGCCTTTGGCTCTGA 1951
184P3G10v.5       ACTCCTAGAACTCATGCAACGAATTGAACTTCCCTTGTCCCTACCAGCCTTTGGCTCTGA 1892
                  ************************************************************

184P3G10v.1       GCAGAATCGCAGAGACCTTCAGAAAGCACTGGTGTCAGGATACTTTCTCAAGGTGGCCAG 1920
184P3G10v.2       GCAGAATCGCAGAGACCTTCAGAAAGCACTGGTGTCAGGATACTTTCTCAAGGTGGCCAG 1889
184P3G10v.3       GCAGAATCGCAGAGACCTTCAGAAAGCACTGGTGTCAGGATACTTTCTCAAGGTGGCCAG 1977
184P3G10v.4       GCAGAATCGCAGAGACCTTCAGAAAGCACTGGTGTCAGGATACTTTCTCAAGGTGGCCAG 2011
184P3G10v.5       GCAGAATCGCAGAGACCTTCAGAAAGCACTGGTGTCAGGATACTTTCTCAAGGTGGCCAG 1952
                  ************************************************************

184P3G10v.1       AGACACAGACGGGACTGGAAATTACCTTCTCCTAACCCATAAGCATGTGGCCCAGCTCTC 1980
184P3G10v.2       AGACACAGACGGGACTGGAAATTACCTTCTCCTAACCCATAAGCATGTGGCCCAGCTCTC 1949
184P3G10v.3       AGACACAGACGGGACTGGAAATTACCTTCTCCTAACCCATAAGCATGTGGCCCAGCTCTC 2037
184P3G10v.4       AGACACAGACGGGACTGGAAATTACCTTCTCCTAACCCATAAGCATGTGGCCCAGCTCTC 2071
184P3G10v.5       AGACACAGACGGGACTGGAAATTACCTTCTCCTAACCCATAAGCATGTGGCCCAGCTCTC 2012
                  ************************************************************

184P3G10v.1       CTCATACTGCTGCTACCGAAGCCGCAGAGCTCCTGCCAGACCCCCACCATGGGTGCTCTA 2040
184P3G10v.2       CTCATACTGCTGCTACCGAAGCCGCAGAGCTCCTGCCAGACCCCCACCATGGGTGCTCTA 2009
```

Figure 13m (continued)

```
184P3G10v.3      CTCATACTGCTGCTACCGAAGCCGCAGAGCTCCTGCCAGACCCCCACCATGGGTGCTCTA 2097
184P3G10v.4      CTCATACTGCTGCTACCGAAGCCGCAGAGCTCCTGCCAGACCCCCACCATGGGTGCTCTA 2131
184P3G10v.5      CTCATACTGCTGCTACCGAAGCCGCAGAGCTCCTGCCAGACCCCCACCATGGGTGCTCTA 2072
                 ************************************************************

184P3G10v.1      CCACAATTTCACCATATCCAAAGACAACTGCCTTTCCATTGTTTCTGAGATTCAACCACA 2100
184P3G10v.2      CCACAATTTCACCATATCCAAAGACAACTGCCTTTCCATTGTTTCTGAGATTCAACCACA 2069
184P3G10v.3      CCACAATTTCACCATATCCAAAGACAACTGCCTTTCCATTGTTTCTGAGATTCAACCACA 2157
184P3G10v.4      CCACAATTTCACCATATCCAAAGACAACTGCCTTTCCATTGTTTCTGAGATTCAACCACA 2191
184P3G10v.5      CCACAATTTCACCATATCCAAAGACAACTGCCTTTCCATTGTTTCTGAGATTCAACCACA 2132
                 ************************************************************

184P3G10v.1      GATGCTGGTGGAATTGGCCCCTCCATACTTCCTGAGTAACTTGCCTCCCAGTGAGAGCAG 2160
184P3G10v.2      GATGCTGGTGGAATTGGCCCCTCCATACTTCCTGAGTAACTTGCCTCCCAGTGAGAGCAG 2129
184P3G10v.3      GATGCTGGTGGAATTGGCCCCTCCATACTTCCTGAGTAACTTGCCTCCCAGTGAGAGCAG 2217
184P3G10v.4      GATGCTGGTGGAATTGGCCCCTCCATACTTCCTGAGTAACTTGCCTCCCAGTGAGAGCAG 2251
184P3G10v.5      GATGCTGGTGGAATTGGCCCCTCCATACTTCCTGAGTAACTTGCCTCCCAGTGAGAGCAG 2192
                 ************************************************************

184P3G10v.1      AGACCTTCTGAACCAGCTAAGGGAAGGAATGGCAGATTCTACAGCAGGGAGCAAATCATC 2220
184P3G10v.2      AGACCTTCTGAACCAGCTAAGGGAAGGAATGGCAGATTCTACAGCAGGGAGCAAATCATC 2189
184P3G10v.3      AGACCTTCTGAACCAGCTAAGGGAAGGAATGGCAGATTCTACAGCAGGGAGCAAATCATC 2277
184P3G10v.4      AGACCTTCTGAACCAGCTAAGGGAAGGAATGGCAGATTCTACAGCAGGGAGCAAATCATC 2311
184P3G10v.5      AGACCTTCTGAACCAGCTAAGGGAAGGAATGGCAGATTCTACAGCAGGGAGCAAATCATC 2252
                 ************************************************************

184P3G10v.1      CTCAGCCCAGGAGTTCAGAGATCCCTGTGTCCTGCAGTGACCTGCCTGCCTATGGAATGG 2280
184P3G10v.2      CTCAGCCCAGGAGTTCAGAGATCCCTGTGTCCTGCAGTGACCTGCCTGCCTATGGAATGG 2249
184P3G10v.3      CTCAGCCCAGGAGTTCAGAGATCCCTGTGTCCTGCAGTGACCTGCCTGCCTATGGAATGG 2337
184P3G10v.4      CTCAGCCCAGGAGTTCAGAGATCCCTGTGTCCTGCAGTGACCTGCCTGCCTATGGAATGG 2371
184P3G10v.5      CTCAGCCCAGGAGTTCAGAGATCCCTGTGTCCTGCAGTGACCTGCCTGCCTATGGAATGG 2312
                 ************************************************************

184P3G10v.1      AGCTGGGTTCATCTCATCACATTAGATTATCCCTCAGGGTGACACCAAAGCACCCAGACA 2340
184P3G10v.2      AGCTGGGTTCATCTCATCACATTAGATTATCCCTCAGGGTGACACCAAAGCACCCAGACA 2309
184P3G10v.3      AGCTGGGTTCATCTCATCACATTAGATTATCCCTCAGGGTGACACCAAAGCACCCAGACA 2397
184P3G10v.4      AGCTGGGTTCATCTCATCACATTAGATTATCCCTCAGGGTGACACCAAAGCACCCAGACA 2431
184P3G10v.5      AGCTGGGTTCATCTCATCACATTAGATTATCCCTCAGGGTGACACCAAAGCACCCAGACA 2372
                 ************************************************************
```

Figure 13m (continued)

```
184P3G10v.1      GATTTAGAAGCCCAAAGTTTAGGGTCAAATGTAAACCCTGGAACCTGAGTCCCAAGAAAT 2400
184P3G10v.2      GATTTAGAAGCCCAAAGTTTAGGGTCAAATGTAAACCCTGGAACCTGAGTCCCAAGAAAT 2369
184P3G10v.3      GATTTAGAAGCCCAAAGTTTAGGGTCAAATGTAAACCCTGGAACCTGAGTCCCAAGAAAT 2457
184P3G10v.4      GATTTAGAAGCCCAAAGTTTAGGGTCAAATGTAAACCCTGGAACCTGAGTCCCAAGAAAT 2491
184P3G10v.5      GATTTAGAAGCCCAAAGTTTAGGGTCAAATGTAAACCCTGGAACCTGAGTCCCAAGAAAT 2432
                 ************************************************************

184P3G10v.1      GGTAGACTGGGAATGGAAAGAATGGGGTAAACCACAGTCTACATAGGGAAGGACTCTTTC 2460
184P3G10v.2      GGTAGACTGGGAATGGAAAGAATGGGGTAAACCACAGTCTACATAGGGAAGGACTCTTTC 2429
184P3G10v.3      GGTAGACTGGGAATGGAAAGAATGGGGTAAACCACAGTCTACATAGGGAAGGACTCTTTC 2517
184P3G10v.4      GGTAGACTGGGAATGGAAAGAATGGGGTAAACCACAGTCTACATAGGGAAGGACTCTTTC 2551
184P3G10v.5      GGTAGACTGGGAATGGAAAGAATGGGGTAAACCACAGTCTACATAGGGAAGGACTCTTTC 2492
                 ************************************************************

184P3G10v.1      CTTAGCCTTCTCTTATTGATTGGAGAGGGACTGACATGCTCCTCATTCTCTTAACTTTGC 2520
184P3G10v.2      CTTAGCCTTCTCTTATTGATTGGAGAGGGACTGACATGCTCCTCATTCTCTTAACTTTGC 2489
184P3G10v.3      CTTAGCCTTCTCTTATTGATTGGAGAGGGACTGACATGCTCCTCATTCTCTTAACTTTGC 2577
184P3G10v.4      CTTAGCCTTCTCTTATTGATTGGAGAGGGACTGACATGCTCCTCATTCTCTTAACTTTGC 2611
184P3G10v.5      CTTAGCCTTCTCTTATTGATTGGAGAGGGACTGACATGCTCCTCATTCTCTTAACTTTGC 2552
                 ************************************************************

184P3G10v.1      CAAACCCATTCTTGTACTCCCTTGTGATCTATAAAAGATTTTTCTATGATGCCAA 2575
184P3G10v.2      CAAACCCATTCTTGTACTCCCTTGTGATCTATAAAAGATTTTTCTATGATGCCAA 2544
184P3G10v.3      CAAACCCATTCTTGTACTCCCTTGTGATCTATAAAAGATTTTTCTATGATGCCAA 2632
184P3G10v.4      CAAACCCATTCTTGTACTCCCTTGTGATCTATAAAAGATTTTTCTATGATGCCAA 2666
184P3G10v.5      CAAACCCATTCTTGTACTCCCTTGTGATCTATAAAAGATTTTTCTATGATGCCAA 2607
                 *******************************************************
```

Figure 14m Alignment of protein sequences of 184P3G10 transcript variants (SEQ ID NOS 46, 151, 152, 153, 154, 155, 156).

```
184P3G10v.1      -----MNTAFAGKMVSVTKYDLTGCSAFCRSCQRATMTSQPLR----------------- 38
184P3G10v.2      ------------------------------------MTSQPLR----------------- 7
184P3G10v.3      -----MNTAFAGKMVSVTKYDLTGCSAFCRSCQRATMTSQPLR----------------- 38
184P3G10v.4A     -----MNTAFAGKMVSVTKYDLTGCSAFCRSCQRATMTSQPLR----------------- 38
184P3G10v.4B     MAHSDLSWPWLGDGQQVYNPRIRAEFQVLRPISKCQAEARRLRARGFPPGSCLCLYPKSF 60
184P3G10v.5A     -----MNTAFAGKMVSVTKYDLTGCSAFCRSCQRATMTSQPLR----------------- 38
184P3G10v.5B     ------------------------------------------------------------
```

Figure 14m (continued)

```
184P3G10v.1         LAEEYGPSPGESELAVNPFDGLPFSSRYYELLKQRQALPIWAARFTFLEQLESNPTGVVL 98
184P3G10v.2         LAEEYGPSPGESELAVNPFDGLPFSSRYYELLKQRQALPIWAARFTFLEQLESNPTGVVL 67
184P3G10v.3         LAEEYGPSPGESELAVNPFDGLPFSSRYYELLKQRQALPIWAARFTFLEQLESNPTGVVL 98
184P3G10v.4A        LAEEYGPSPGESELAVNPFDGLPFSSRYYELLKQRQALPIWAARFTFLEQLESNPTGVVL 98
184P3G10v.4B        LELEAPPLPQPRVCEENLSSLVLLLKRRQIAEPGECHFLDQPAPEALMQALEDLDYLAAL 120
184P3G10v.5A        LAEEYGPSPGESELAVNPFDGLPFSSRYYELLKQRQALPIWAARFTFLEQLESNPTGVVL 98
184P3G10v.5B        -----------------------------------------------MQALEDLDYLAAL 13
                                                                      **       *

184P3G10v.1         VSGEPGSGKSTQIPQWCAEFALARGFQKGQVTVTQPYPLAARSLALRVADEMDLTLGHEV 158
184P3G10v.2         VSGEPGSGKSTQIPQWCAEFALARGFQKGQVTVTQPYPLAARSLALRVADEMDLTLGHEV 127
184P3G10v.3         VSGEPGSGKSTQIPQWCAEFALARGFQKGQVTVTQPYPLAARSLALRVADEMDLTLGHEV 158
184P3G10v.4A        VSGEPGSGKSTQIPQWCAEFALARGFQKGQVTVTQPYPLAARSLALRVADEMDLTLGHEV 158
184P3G10v.4B        DDDGDLSDLGVILSEFPLAPELAKALLASCEFDCVDEMLTLAAMLTAAPGFTRPPLSAEE 180
184P3G10v.5A        VSGEPGSGKSTQIPQWCAEFALARGFQKGQVTVTQPYPLAARSLALRVADEMDLTLGHEV 158
184P3G10v.5B        DDDGDLSDLGVILSEFPLAPELAKALLASCEFDCVDEMLTLAAMLTAAPGFTRPPLSAEE 73
                          *              **               *                *  *

184P3G10v.1         GYSIPQEDCTGPNTLLRFCWDRLLLQEVASTRGTGAWGVLVLDEAQERSVASDSLQGLLQ 218
184P3G10v.2         GYSIPQEDCTGPNTLLRFCWDRLLLQEVASTRGTGAWGVLVLDEAQERSVASDSLQGLLQ 187
184P3G10v.3         GYSIPQEDCTGPNTLLRFCWDRLLLQEVASTRGTGAWGVLVLDEAQERSVASDSLQGLLQ 218
184P3G10v.4A        GYSIPQEDCTGPNTLLRFCWDRLLLQEVASTRGTGAWGVLVLDEAQERSVASDSLQGLLQ 218
184P3G10v.4B        AALRRALEHTDGDHSSLIQVYEAFIQSGADEAWCQARGLNWAALCQAHKLRGELLELMQR 240
184P3G10v.5A        GYSIPQEDCTGPNTLLRFCWDRLLLQEVASTRGTGAWGVLVLDEAQERSVASDSLQGLLQ 218
184P3G10v.5B        AALRRALEHTDGDHSSLIQVYEAFIQSGADEAWCQARGLNWAALCQAHKLRGELLELMQR 133
                             *               *  *      * *       *        *

184P3G10v.1         DARLEKLPGDLRVVVVTDPALEPKLRAFWGNPPIVHIPREPGERPSPIYWDTIPPDRVEA 278
184P3G10v.2         DARLEKLPGDLRVVVVTDPALEPKLRAFWGNPPIVHIPREPGERPSPIYWDTIPPDRVEA 247
184P3G10v.3         DARLEKLPGDLRVVVVTDPALEPKLRAFWGNPPIVHIPREPGERPSPIYWDTIPPDRVEA 278
184P3G10v.4A        DARLEKLPGDLRVVVVTDPALEPKLRAFWGNPPIVHIPREPGERPSPIYWDTIPPDRVEA 278
184P3G10v.4B        IELPLSLP------AFGSEQNRRDLQKALVSGYFLKVARDTDGTGNYLLLTHKHVAQLSS 294
184P3G10v.5A        DARLEKLPGDLRVVVVTDPALEPKLRAFWGNPPIVHIPREPGERPSPIYWDTIPPDRVEA 278
184P3G10v.5B        IELPLSLP------AFGSEQNRRDLQKALVSGYFLKVARDTDGTGNYLLLTHKHVAQLSS 187
                          **                 *             *

184P3G10v.1         ACQAVLELCRKELPGDVLVFLPSE------------------EEISLCCESLSREVESL 319
184P3G10v.2         ACQAVLELCRKELPGDVLVFLPSE------------------EEISLCCESLSREVESL 288
184P3G10v.3         ACQAVLELCRKELPGDVLVFLPSEEVKKQNKTKKTACKMSLQKEEISLCCESLSREVESL 338
```

Figure 14m (continued)

```
184P3G10v.4A     ACQAVLELCRKELPGDVLVFLPSE-------------------EEISLCCESLSREVESL 319
184P3G10v.4B     YCCYRSRRAPARPPPWVLYHNFTI-------------------SKDNCLSIVSEIQPQML 335
184P3G10v.5A     ACQAVLELCRKELPGDVLVFLPSE-------------------EEISLCCESLSREVESL 319
184P3G10v.5B     YCCYRSRRAPARPPPWVLYHNFTI-------------------SKDNCLSIVSEIQPQML 228
                  *           *  **                                         *

184P3G10v.1      LLQGLPPRVLPLHPDCGRAVQAVYEDMDARKVVVTHWLADFSFSLPSIQHVIDSGLELRS 379
184P3G10v.2      LLQGLPPRVLPLHPDCGRAVQAVYEDMDARKVVVTHWLADFSFSLPSIQHVIDSGLELRS 348
184P3G10v.3      LLQGLPPRVLPLHPDCGRAVQAVYEDMDARKVVVTHWLADFSFSLPSIQHVIDSGLELRS 398
184P3G10v.4A     LLQGLPPRVLPLHPDCGRAVQAVYEDMDARKVVVTHWLADFSFSLPSIQHVIDSGLELRS 379
184P3G10v.4B     VELAPPYFLSNLPPSESRDLLNQLREGMADSTAGSKSSSAQEFRDPCVLQ---------- 385
184P3G10v.5A     LLQGLPPRVLPLHPDCGRAVQAVYEDMDARKVVVTHWLADFSFSLPSIQHVIDSGLELRS 379
184P3G10v.5B     VELAPPYFLSNLPPSESRDLLNQLREGMADSTAGSKSSSAQEFRDPCVLQ---------- 278
                      *     * *   *          *             *  *

184P3G10v.1      VYNPRIRAEFQVLRPISKCQAEARRLRARGFPPGSCLCLYPKSFLELEAPPLPQPRVCEE 439
184P3G10v.2      VYNPRIRAEFQVLRPISKCQAEARRLRARGFPPGSCLCLYPKSFLELEAPPLPQPRVCEE 406
184P3G10v.3      VYNPRIRAEFQVLRPISKCQAEARRLRARGFPPGSCLCLYPKSFLELEAPPLPQPRVCEE 458
184P3G10v.4A     VSERER------------------------------------------------------ 385
184P3G10v.4B     ------------------------------------------------------------
184P3G10v.5A     VYNPRIRAEFQVLRPISKCQAEARRLRARGFPPVVFFFRSFSPQDPASACILSPS----- 434
184P3G10v.5B     ------------------------------------------------------------

184P3G10v.1      NLSSLVLLLKRRQIAEPGECHFLDQPAPEALMQALEDLDYLAALDDDGDLSDLGVILSEF 499
184P3G10v.2      NLSSLVLLLKRRQIAEPGECHFLDQPAPEALMQALEDLDYLAALDDDGDLSDLGVILSEF 468
184P3G10v.3      NLSSLVLLLKRRQIAEPGECHFLDQPAPEALMQALEDLDYLAALDDDGDLSDLGVILSEF 518
184P3G10v.4A     ------------------------------------------------------------
184P3G10v.4B     ------------------------------------------------------------
184P3G10v.5A     ------------------------------------------------------------
184P3G10v.5B     ------------------------------------------------------------

184P3G10v.1      PLAPELAKALLASCEFDCVDEMLTLAAMLTAAPGFTRPPLSAEEAALRRALEHTDGDHSS 559
184P3G10v.2      PLAPELAKALLASCEFDCVDEMLTLAAMLTAAPGFTRPPLSAEEAALRRALEHTDGDHSS 528
184P3G10v.3      PLAPELAKALLASCEFDCVDEMLTLAAMLTAAPGFTRPPLSAEEAALRRALEHTDGDHSS 578
184P3G10v.4A     ------------------------------------------------------------
184P3G10v.4B     ------------------------------------------------------------
184P3G10v.5A     ------------------------------------------------------------
```

```
184P3G10v.5B       ------------------------------------------------------------

184P3G10v.1        LIQVYEAFIQSGADEAWCQARGLNWAALCQAHKLRGELLELMQRIELPLSLPAFGSEQNR 619
184P3G10v.2        LIQVYEAFIQSGADEAWCQARGLNWAALCQAHKLRGELLELMQRIELPLSLPAFGSEQNR 588
184P3G10v.3        LIQVYEAFIQSGADEAWCQARGLNWAALCQAHKLRGELLELMQRIELPLSLPAFGSEQNR 638
184P3G10v.4A       ------------------------------------------------------------
184P3G10v.4B       ------------------------------------------------------------
184P3G10v.5A       ------------------------------------------------------------
184P3G10v.5B       ------------------------------------------------------------

184P3G10v.1        RDLQKALVSGYFLKVARDTDGTGNYLLLTHKHVAQLSSYCCYRSRRAPARPPPWVLYHNF 679
184P3G10v.2        RDLQKALVSGYFLKVARDTDGTGNYLLLTHKHVAQLSSYCCYRSRRAPARPPPWVLYHNF 648
184P3G10v.3        RDLQKALVSGYFLKVARDTDGTGNYLLLTHKHVAQLSSYCCYRSRRAPARPPPWVLYHNF 698
184P3G10v.4A       ------------------------------------------------------------
184P3G10v.4B       ------------------------------------------------------------
184P3G10v.5A       ------------------------------------------------------------
184P3G10v.5B       ------------------------------------------------------------

184P3G10v.1        TISKDNCLSIVSEIQPQMLVELAPPYFLSNLPPSESRDLLNQLREGMADSTAGSKSSSAQ 739
184P3G10v.2        TISKDNCLSIVSEIQPQMLVELAPPYFLSNLPPSESRDLLNQLREGMADSTAGSKSSSAQ 708
184P3G10v.3        TISKDNCLSIVSEIQPQMLVELAPPYFLSNLPPSESRDLLNQLREGMADSTAGSKSSSAQ 758
184P3G10v.4A       ------------------------------------------------------------
184P3G10v.4B       ------------------------------------------------------------
184P3G10v.5A       ------------------------------------------------------------
184P3G10v.5B       ------------------------------------------------------------

184P3G10v.1        EFRDPCVLQ 748
184P3G10v.2        EFRDPCVLQ 717
184P3G10v.3        EFRDPCVLQ 767
184P3G10v.4A       ---------
184P3G10v.4B       ---------
184P3G10v.5A       ---------
184P3G10v.5B       ---------
```

Figure 11n Nucleotide sequences of transcript variants of 185P2C9

>185P2C9 v.2 (SEQ ID NO:157).

```
cacgggggaa gcaggcgggc cccccagcac ccgggaggcc gagctgaagc tgcggctaaa      60
gctggtggag gaggaagcca acatcttggg ccggaagatc gtggagctgg aggtggagaa     120
ccgtggcctc aaggcagaga tggaggacac gcggggccag caggagcggg agggcccggg     180
tcgggaccac gcacccagca ttcctacctc acccttcggt gactccctgg agtcctccac     240
tgagctccgc cgccacctgc agtttgtaga agaggaagcg gagttgctcc ggaggtccat     300
ctccgagatc gaagaccaca accggcaact gacccacgag ctcagcaagt ttaagtttga     360
gcctcccccgg gagccgggct ggctaggaga gggtgcaagt cctggtgccg gggtggggc     420
cccccctgcag gaggagctga agtcagccag gctgcagatc agcgagctca gcggcaaggt     480
gctcaaactg cagcacgaga accacgcgct gctgtccaac atccagcgct gcgacctggc     540
agcccacctg gggctgcgtg cccccagtcc ccgggacagc gatgccgaga gtgatgcggg     600
caagaaggag agtgatgggg aggagagccg cctgccccag cccaagcggg aagggcctgt     660
tggcggggag agtgactcgg aggagatgtt tgagaagacg tcgggcttcg ggagcgggaa     720
gccatcggag gccagcgagc catgccccac ggagctcctg aaggcccggg aggactctga     780
gtacctagtg accctaaaac acgaggccca gcggctagag cggacggtgg agcgcctcat     840
cacggacacc gacagcttcc tccatgatgc ggggctgcgg ggtggtgcgc ccttacccggg     900
gcctggcctc cagggcgaag aggagcaggg tgaggggac cagcaggagc cccagctgct     960
ggggaccatc aacgccaaga tgaaggcttt caagaaagag ctgcaggcct tcctgcagca    1020
ggtgaaccgc attggggatg gcctatcccc cttgccccac ctcacagagt cctctagctt    1080
cctctccact gtgacttccg tgtcccggga ctcccccatc gggaacctgg ggaaggagct    1140
gggcccagac ttgcagtcca gactgaaaga gcagctggag tggcagctcg ggccggccca    1200
aggggacgag cgggagagcc tgcgcctccg agccgcgcgg gagctgcacc gccgcgcaga    1260
cggggacacc gggagccacg ggctgggagg ccagacctgc ttcagcctgg agatggagga    1320
ggagcacctc tatgccttga ggtggaaaga actggaaatg cacagcctgg ctttgcaaaa    1380
caccctccat gagcgaacct ggagtgatga gaagaatctg atgcagcagg agctccggtc    1440
cttgaagcag aacatttcc tcttctacgt caaactcagg tggctgctga aacactggcg    1500
gcaagggaag cagatggagg aggaaggaga ggagttcact gagggtgaac atccagagac    1560
cctctccagg ctcggggagc ttggagtcca gggggtcac caggcggatg gcccagacca    1620
cgacagtgac cgaggctgtg gctttccagt gggggagcac tccccacact cccgggtgca    1680
gattggagat cacagcttgc ggctgcagac cgcggacagg ggacagcccc acaaacaggt    1740
ggtggaaaac cagcagctgt tcagcgcctt caaggccttg ctggaggact tccgtgcgga    1800
gctgcgggag gatgagcgtg cccgactacg gctgcagcag caatatgcca gcgacaaggc    1860
ggcctgggac gtggagtggg ccgtgctcaa gtgccgtctg gaacagctgg aagagaagac    1920
tgagaacaag ttgggagaac taggctcctc cgctgagagc aaggggggcct tgaagaagga    1980
gagagaggtg caccagaagc tcctggcaga cagtcacagc ctggtcatgg acctgcgctg    2040
gcagatccat cacagcgaga agaactggaa ccgggagaag gtggaacttc tcgaccgcct    2100
ggacagagat cggcaggagt gggagcggca gaagaaggaa ttcttgtgga ggatagagca    2160
gttgcagaaa gagaacagtc cccggagagg tggcagtttc ctctgtgatc aaaaagacgg    2220
caacgttcgc cccttttcccc accagggaag cctccgcatg ccccgtccag tggccatgtg    2280
```

Figure 11n (continued)

```
gccttgtgca gatgctgact ccatcccgtt tgaagaccgg ccgctgtcca agctgaagga    2340
gtcggacagg tgctcggcca gtgagaatct ctacctggat gccttgtccc tggatgacga    2400
gccagaagag ccaccagccc acaggcccga gagggagttc aggaaccgcc tccctgagga    2460
agaagaaaat cacaaaggaa atcttcaaag ggcggtgtcc gtgtcctcca tgtctgagtt    2520
ccagcgtcta atggacatct ccccttcct gcctgagaag ggcctgccgt ccaccagcag    2580
caaggaggat gtcaccccac ccctgtctcc agacgacctc aagtacatcg aggagttcaa    2640
caagagctgg gactacacac ccaacagggg ccacaatggt gggggccgg acctttgggc    2700
cgacaggacc gaggtggggc gggcagggca cgaggacagc acagagcctt tccccgactc    2760
ctcctggtac ctaaccacaa gtgtcaccat gacccacggac accatgacca gcccagagca    2820
ctgccagaag cagccactgc ggagccacgt cctcaccgag cagtcggggt tgcgcgtgtt    2880
acacagcccg cctgccgtgc gcagggtcga cagcatcacg gcggcaggtg gtgagggtcc    2940
ctttcccaca agcagagcca gagggagccc gggagacacc aagggggcc ctccagaacc    3000
catgctcagc aggtggcctt gcacctcccc caggcactcc cgggactatg tggaggggc    3060
acggcgcccc cttgatagtc ccctctgtac ctccctgggg tttgcctccc cactgcacag    3120
cctggagatg tccaagaact tgagtgatga catgaaggag gtggccttct ctgtcaggaa    3180
tgccatctgc tccggccctg gcgagctgca agtcaaggac atggcctgcc agaccaatgg    3240
gtccggacg atggggaccc agactgttca gaccatcagt gtgggcttgc agactgaagc    3300
cctgcgtggc agcggtgtca ccagcagccc ccacaagtgt ctcactccaa aggctggggg    3360
cggtgctaca cccgtgtcgt ctccttcccg gagccttagg agcagacagg tggcccctgc    3420
catcgagaag gtgcaggcca agtttgaacg cacatgctgc tcccccaagt atggttctcc    3480
caagctgcag aggaagcccc tccccaaagc cgaccagcca aataacaggc caggaaacag    3540
gcaccaattc ccgaggaagg tcgcctagcc ccattggggt ggggtcagag atgtgcaggg    3600
aggaaggggg agagggcacg ccagtgaagc aggacttatc tgctccccct ggctacaccc    3660
tcactgagaa cgtggcccgg atcctcaaca agaagctgct ggaacatgcc ttaaaggagg    3720
agaggaggca ggctgcccac gggcccccgg gtctccacag tgacagccac tcgctggggg    3780
acacagccga gccagggccc atggaggaac taccttgttc tgcactagct ccatccctag    3840
agccctgctt ctccaggccc gagagaccag caaaccgtcg ccctccgtcc cgttgggccc    3900
cacattcccc cactgcctca cagcctcagt caccccggaga cccgacgtcc ttggaggagc    3960
atggtggcga ggagccgccc gaggagcagc cacaccgaga tgcaagcttg catggattat    4020
cacagtataa ttcactgtaa tttgcataac cacaccatca ccatgaacaa aactctgccc    4080
aacaggagag atctagtttt ctcaaggtca aagaatgttt tttaaaaaca caaagctgct    4140
gaatgttcaa cctgtgaaac tgagatgttt ctagaatgaa acagtaaatg tgcctgtaat    4200
aacttaattt ttttcatagc tcagaaaact atttttgtct ccatcttttt tacacacagt    4260
atattaaacg aaaaggtaaa taaggtataa atagatttaa aaaataaaag ttttaaaaaa    4320
tgtacatttt aagagattct gaacaccctc gctgtcaata cctgactgcc tctgttaaat    4380
ttgcactgtt acattttggt tcagtttatt tccatgttga attagagtgg attaagttaa    4440
ttttattttg tcagtgttac tgtttttttac gaatttttta atgcttcaga ctgtctgatt    4500
cagtgaactt tttgtagtga aaaagccatg aagccagtag acaagacaga tattctgtat    4560
gctggagggg atacaggatg attttgaaaa ggtacaaagt cctcagtggg cttagaaaat    4620
```

Figure 11n (continued)

```
tcactgtatg atccttatat tatcctactt ggcttgcacg tcttcgggtg catgtatata    4680
ccgctactgt gtcctcgcca tcacctaaat gtgactcagt ctgttccact gtaatatgtt    4740
gtgaatttcc ttgtactgta cttttattgt tggtcttctt gcatcgatga tccaacagca    4800
acaccatttt taaattattg tgaaaagatt aactggcaat gtacagagtt tactcaaagt    4860
tttcttaagg gaaaacacta caaaaagtca caaggatacc aaatggaaac acatgatgat    4920
gcctctgggt ctgtatgaga ccgtgatgaa gtagaaataa agcccttctg agatggc       4977
```

>185P2C9 v.3 (SEQ ID NO:158).

```
cacgggggaa gcaggcgggc cccccagcac ccgggaggcc gagctgaagc tgcggctaaa      60
gctggtggag gaggaagcca acatcttggg ccggaagatc gtggagctgg aggtggagaa     120
ccgtggcctc aaggcagaga tggaggacac gcggggccag caggagcggg agggcccggg     180
tcgggaccac gcacccagca ttcctacctc acccttcggt gactccctgg agtcctccac     240
tgagctccgc cgccacctgc agtttgtaga agaggaagcg gagttgctcc ggaggtccat     300
ctccgagatc gaagaccaca accggcaact gacccacgag ctcagcaagt ttaagtttga     360
gcctcccccgg gagccgggct ggctaggaga gggtgcaagt cctggtgccg gggtggggc     420
cccctgcag gaggagctga agtcagccag gctgcagatc agcgagctca gcggcaaggt     480
gctcaaactg cagcacgaga accacgcgct gctgtccaac atccagcgct gcgacctggc     540
agcccacctg ggctgcgtg cccccagtcc ccgggacagc gatgccgaga gtgatgcggg     600
caagaaggag agtgatgggg aggagagccg cctgccccag cccaagtggg aagggcctgt     660
tggcggggag agtgactcgg aggagatgtt tgagaagacg tcgggcttcg ggagcgggaa     720
gccatcggag gccagcgagc catgccccac ggagctcctg aaggcccggg aggactctga     780
gtacctagtg accctaaaac acgaggccca gcggctagag cggacggtgg agcgcctcat     840
cacggacacc gacagcttcc tccatgatgc ggggctgcgg ggtggtgcgc ccttaccggg     900
gcctggcctc cagggcgaag aggagcaggg tgaggggac cagcaggagc cccagctgct     960
ggggaccatc aacgccaaga tgaaggcttt caagaaagag ctgcaggcct tcctggagca    1020
ggtgaaccgc attggggatg gcctatcccc cttgccccac ctcacagagt cctctagctt    1080
cctctccact gtgacttccg tgtcccggga ctcccccatc gggaacctgg ggaaggagct    1140
gggcccagac ttgcagtcca gactgaaaga gcagctggag tggcagctcg ggccggcccg    1200
aggggacgag cgggagagcc tgcgcctccg agccgcgcgg gagctgcacc gccgcgcaga    1260
cggggacacc gggagccacg ggctgggagg ccagacctgc ttcagcctgg agatggagga    1320
ggagcacctc tatgccttga ggtggaaaga actggaaatg cacagcctgg ctttgcaaaa    1380
caccctccat gagcgaacct ggagtgatga gaagaatctg atgcagcagg agctccggtc    1440
cttgaagcag aacattttcc tcttctacgt caaactcagg tggctgctga aacactggcg    1500
gcaagggaag cagatggagg aggaaggaga ggagttcact gagggtgaac atccagagac    1560
cctctccagg ctcggggagc ttggagtcca gggggtcac caggcggatg gcccagacca    1620
cgacagtgac cgaggctgtg gctttccagt gggggagcac tccccacact cccgggtgca    1680
gattggagat cacagcttgc ggctgcagac cgcggacagg ggacagcccc acaaacaggt    1740
ggtggaaaac cagcagctgt tcagcgcctt caaggccttg ctggaggact tccgtgcgga    1800
gctgcgggag gatgagcgtg cccgactacg gctgcagcag caatatgcca gcgacaaggc    1860
```

Figure 11n (continued)

```
ggcctgggac gtggagtggg ccgtgctcaa gtgccgtctg gaacagaatt gttgtggata   1920
tcccagaatt aacattgagg aggagacttt aggcttcacc aggctgccag ctgggtccac   1980
ggtaaaaacg ttgaagagcc ttgggttgca gagattggag ctggaagaga agactgagaa   2040
caagttggga gaactaggct cctccgctga gagcaagggg gccttgaaga aggagagaga   2100
ggtgcaccag aagctcctgg cagacagtca cagcctggtc atggacctgc gctggcagat   2160
ccatcacagc gagaagaact ggaaccggga gaaggtggaa cttctcgacc gcctggacag   2220
agatcggcag gagtgggagc ggcagaagaa ggaattcttg tggaggatag agcagggaag   2280
cctccgcatg ccccgtccag tggccatgtg gccttgtgca gatgctgact ccatcccgtt   2340
tgaagaccgg ccgctgtcca agctgaagga gtcggacagg tgctcggcca gtgagaatct   2400
ctacctggat gccttgtccc tggatgacga gccagaagag ccaccagccc acaggcccga   2460
gagggagttc aggaaccgcc tccctgagga agaagaaaat cacaaaggaa atcttcaaag   2520
ggcggtgtcc gtgtcctcca tgtctgagtt ccagcgtcta atggacatct ccccttcct   2580
gcctgagaag ggcctgccgt ccaccagcag caaggaggat gtcaccccac ccctgtctcc   2640
agacgacctc aagtacatcg aggagttcaa caagagctgg gactacacac ccaacagggg   2700
ccacaatggt gggggccgg acctttgggc cgacaggacc gaggtggggc gggcagggca   2760
cgaggacagc acagagcctt tccccgactc ctcctggtac ctaaccacaa gtgtcaccat   2820
gaccacggac accatgacca gcccagagca ctgccagaag cagccactgc ggagccacgt   2880
cctcaccgag cagtcggggt tgcgcgtgtt acacagcccg cctgccgtgc gcagggtcga   2940
cagcatcacg gcggcaggtg gtgagggtcc ctttcccaca agcagagcca gagggagccc   3000
gggagacacc aagggggcc ctccagaacc catgctcagc aggtggcctt gcacctcccc   3060
caggcactcc cgggactatg tggagggggc acggcgcccc cttgatagtc ccctctgtac   3120
ctccctgggg tttgcctccc cactgcacag cctggagatg tccaagaact tgagtgatga   3180
catgaaggag gtggccttct ctgtcaggaa tgccatctgc tccggccctg gcgagctgca   3240
agtcaaggac atggcctgcc agaccaatgg gtcccggacg atggggaccc agactgttca   3300
gaccatcagt gtgggcttgc agactgaagc cctgcgtggc agcggtgtca ccagcagccc   3360
ccacaagtgt ctcactccaa aggctggggg cggtgctaca cccgtgtcgt ctccttcccg   3420
gagccttagg agcagacagg tggcccctgc catcgagaag gtgcaggcca agtttgaacg   3480
cacatgctgc tcccccaagt atggttctcc caagctgcag aggaagcccc tccccaaagc   3540
cgaccagcca aataacagga cgtcaccagg gatggcccag aaagggtaca gtgagtcagc   3600
ctgggcccgc tccaccacca caagggagag ccccgtgcac accaccatta atgatggcct   3660
ctccagcctc ttcaacatca ttgaccacag ccccgtggtg caggacccct tccagaaggg   3720
gctgcgggcc ggcagtcggt ctcgctcagc agagccccga ccagagctgg gcccaggcca   3780
ggaaacaggc accaattccc gaggaaggtc gcctagcccc attggggtgg ggtcagagat   3840
gtgcagggag gaaggggag agggcacgcc agtgaagcag gacttatctg ctcccctgg   3900
ctacaccctc actgagaacg tggcccggat cctcaacaag aagctgctgg aacatgcctt   3960
aaaggaggag aggaggcagg ctgcccacgg gcccccgggt ctccacagtg acagccactc   4020
gctgggggac acagccgagc cagggcccat ggaggaacta ccttgttctg cactagctcc   4080
atccctagag ccctgcttct ccaggcccga gagaccagca aaccgtcgcc ctccgtcccg   4140
ttgggcccca cattccccca ctgcctcaca gcctcagtca cccggagacc cgacgtcctt   4200
```

Figure 11n (continued)

```
ggaggagcat ggtggcgagg agccgcccga ggagcagcca caccgagatg caagcttgca     4260
tggattatca cagtataatt cactgtaatt tgcataacca caccatcacc atgaacaaaa     4320
ctctgcccaa caggagagat ctagttttct caaggtcaaa gaatgttttt taaaaacaca     4380
aagctgctga atgttcaacc tgtgaaactg agatgtttct agaatgaaac agtaaatgtg     4440
cctgtaataa cttaattttt ttcatagctc agaaaactat ttttgtctcc atcttttta      4500
cacacagtat attaaacgaa aaggtaaata aggtataaat agatttaaaa aataaaagtt     4560
ttaaaaaatg tacattttaa gagattctga acaccctcgc tgtcaatacc tgactgcctc     4620
tgttaaattt gcactgttac attttggttc agtttatttc catgttgaat tagagtggat     4680
taagttaatt ttattttgtc agtgttactg tttttacga atttttaat gcttcagact       4740
gtctgattca gtgaactttt tgtagtgaaa aagccatgaa gccagtagac aagacagata     4800
ttctgtatgc tggaggggat acaggatgat tttgaaaagg tacaaagtcc tcagtgggct     4860
tagaaaattc actgtatgat ccttatatta tcctacttgg cttgcacgtc ttcgggtgca     4920
tgtatatacc gctactgtgt cctcgccatc acctaaatgt gactcagtct gttccactgt     4980
aatatgttgt gaatttcctt gtactgtact tttattgttg gtcttcttgc atcgatgatc     5040
caacagcaac accattttta aattattgtg aaaagattaa ctggcaatgt acagagttta     5100
ctcaaagttt tcttaaggga aaacactaca aaaagtcaca aggataccaa atggaaacac     5160
atgatgatgc ctctgggtct gtatgagacc gtgatgaagt agaaataaag cccttctgag     5220
atggc                                                                 5225
```

Figure 12n Protein sequences of transcript variants of 185P2C9

>185P2C9 v.2 (SEQ ID NO:159).

```
MEDTRGQQER EGPGRDHAPS IPTSPFGDSL ESSTELRRHL QFVEEEAELL RRSISEIEDH       60
NRQLTHELSK FKFEPPREPG WLGEGASPGA GGGAPLQEEL KSARLQISEL SGKVLKLQHE      120
NHALLSNIQR CDLAAHLGLR APSPRDSDAE SDAGKKESDG EESRLPQPKR EGPVGGESDS      180
EEMFEKTSGF GSGKPSEASE PCPTELLKAR EDSEYLVTLK HEAQRLERTV ERLITDTDSF      240
LHDAGLRGGA PLPGPGLQGE EEQGEGDQQE PQLLGTINAK MKAFKKELQA FLQQVNRIGD      300
GLSPLPHLTE SSSFLSTVTS VSRDSPIGNL GKELGPDLQS RLKEQLEWQL GPAQGDERES      360
LRLRAARELH RRADGDTGSH GLGGQTCFSL EMEEEHLYAL RWKELEMHSL ALQNTLHERT      420
WSDEKNLMQQ ELRSLKQNIF LFYVKLRWLL KHWRQGKQME EEGEEFTEGE HPETLSRLGE      480
LGVQGGHQAD GPDHDSDRGC GFPVGEHSPH SRVQIGDHSL RLQTADRGQP HKQVVENQQL      540
FSAFKALLED FRAELREDER ARLRLQQQYA SDKAAWDVEW AVLKCRLEQL EEKTENKLGE      600
LGSSAESKGA LKKEREVHQK LLADSHSLVM DLRWQIHHSE KNWNREKVEL LDRLDRDRQE      660
WERQKKEFLW RIEQLQKENS PRRGGSFLCD QKDGNVRPFP HQGSLRMPRP VAMWPCADAD      720
SIPFEDRPLS KLKESDRCSA SENLYLDALS LDDEPEEPPA HRPEREFRNR LPEEEENHKG      780
NLQRAVSVSS MSEFQRLMDI SPFLPEKGLP STSSKEDVTP PLSPDDLKYI EEFNKSWDYT      840
PNRGHNGGGP DLWADRTEVG RAGHEDSTEP FPDSSWYLTT SVTMTTDTMT SPEHCQKQPL      900
RSHVLTEQSG LRVLHSPPAV RRVDSITAAG GEGPFPTSRA RGSPGDTKGG PPEPMLSRWP      960
CTSPRHSRDY VEGARRPLDS PLCTSLGFAS PLHSLEMSKN LSDDMKEVAF SVRNAICSGP     1020
```

Figure 12n (continued)

```
GELQVKDMAC QTNGSRTMGT QTVQTISVGL QTEALRGSGV TSSPHKCLTP KAGGGATPVS    1080
SPSRSLRSRQ VAPAIEKVQA KFERTCCSPK YGSPKLQRKP LPKADQPNNR PGNEHQFPRK    1140
VA                                                                   1142
```

>185P2C9 v.3 (SEQ ID NO:160).

```
MEDTRGQQER EGPGRDHAPS IPTSPFGDSL ESSTELRRHL QFVEEEAELL RRSISEIEDH      60
NRQLTHELSK FKFEPPREPG WLGEGASPGA GGGAPLQEEL KSARLQISEL SGKVLKLQHE     120
NHALLSNIQR CDLAAHLGLR APSPRDSDAE SDAGKKESDG EESRLPQPKW EGPVGGESDS     180
EEMFEKTSGF GSGKPSEASE PCPTELLKAR EDSEYLVTLK HEAQRLERTV ERLITDTDSF     240
LHDAGLRGGA PLPGPGLQGE EEQGEGDQQE PQLLGTINAK MKAFKKELQA FLEQVNRIGD     300
GLSPLPHLTE SSSFLSTVTS VSRDSPIGNL GKELGPDLQS RLKEQLEWQL GPARGDERES     360
LRLRAARELH RRADGDTGSH GLGGQTCFSL EMEEEHLYAL RWKELEMHSL ALQNTLHERT     420
WSDEKNLMQQ ELRSLKQNIF LFYVKLRWLL KHWRQGKQME EEGEEFTEGE HPETLSRLGE     480
LGVQGGHQAD GPDHDSDRGC GFPVGEHSPH SRVQIGDHSL RLQTADRGQP EKQVVENQQL     540
FSAFKALLED FRAELREDER ARLRLQQQYA SDKAAWDVEW AVLKCRLEQN CCGYPRINIE     600
EETLGFTRLP AGSTVKTLKS LGLQRLELEE KTENKLGELG SSAESKGALK KEREVHQKLL     660
ADSHSLVMDL RWQIHHSEKN WNREKVELLD RLDRDRQEWE RQKKEFLWRI EQGSLRMPRF     720
VAMWPCADAD SIPFEDRPLS KLKESDRCSA SENLYLDALS LDDEPEEPPA HRPEREFRNR     780
LPEEEENHKG NLQRAVSVSS MSEFQRLMDI SPFLPEKGLP STSSKEDVTP PLSPDDLKYI     840
EEFNKSWDYT PNRGHNGGGP DLWADRTEVG RAGHEDSTEP FPDSSWYLTT SVTMTTDTMT     900
SPEHCQKQPL RSHVLTEQSG LRVLHSPPAV RRVDSITAAG GEGPFPTSRA RGSPGDTKGG     960
PPEPMLSRWP CTSPRHSRDY VEGARRPLDS PLCTSLGFAS PLHSLEMSKN LSDDMKEVAF    1020
SVRNAICSGP GELQVKDMAC QTNGSRTMGT QTVQTISVGL QTEALRGSGV TSSPHKCLTP    1080
KAGGGATPVS SPSRSLRSRQ VAPAIEKVQA KFERTCCSPK YGSPKLQRKP LPKADQPNNR    1140
TSPGMAQKGY SESAWARSTT TRESPVHTTI NDGLSSLFNI IDHSPVVQDP FQKGLRAGSR    1200
SRSAEPRPEL GPGQETGTNS RGRSPSPIGV GSEMCREEGG EGTPVKQDLS APPGYTLTEN    1260
VARILNKKLL EHALKEERRQ AAHGPPGLHS DSHSLGDTAE PGPMEELPCS ALAPSLEPCF    1320
SRPERPANRR PPSRWAPHSP TASQPQSPGD PTSLEEHGGE EPPEEQPHRD ASLHGLSQYN    1380
SL                                                                  1382
```

Figure 13n Alignment of nucleotide sequences of 185P2C9 transcript variants (SEQ ID NOS:47, 157, 158).

```
185P2C9v.1      CACGGGGGAAGCAGGCGGGCCCCCCAGCACCCGGGAGGCCGAGCTGAAGCTGCGGCTAAA 60
185P2C9v.2      CACGGGGGAAGCAGGCGGGCCCCCCAGCACCCGGGAGGCCGAGCTGAAGCTGCGGCTAAA 60
185P2C9v.3      CACGGGGGAAGCAGGCGGGCCCCCCAGCACCCGGGAGGCCGAGCTGAAGCTGCGGCTAAA 60
                ************************************************************

185P2C9v.1      GCTGGTGGAGGAGGAAGCCAACATCTTGGGCCGGAAGATCGTGGAGCTGGAGGTGGAGAA 120
```

Figure 13n (continued)

```
185P2C9v.2      GCTGGTGGAGGAGGAAGCCAACATCTTGGGCCGGAAGATCGTGGAGCTGGAGGTGGAGAA 120
185P2C9v.3      GCTGGTGGAGGAGGAAGCCAACATCTTGGGCCGGAAGATCGTGGAGCTGGAGGTGGAGAA 120
                ************************************************************

185P2C9v.1      CCGTGGCCTCAAGGCAGAGATGGAGGACATGCGGGGCCAGCAGGAGCGGGAGGGCCCGGG 180
185P2C9v.2      CCGTGGCCTCAAGGCAGAGATGGAGGACACGCGGGGCCAGCAGGAGCGGGAGGGCCCGGG 180
185P2C9v.3      CCGTGGCCTCAAGGCAGAGATGGAGGACACGCGGGGCCAGCAGGAGCGGGAGGGCCCGGG 180
                ***************************** ******************************

185P2C9v.1      TCGGGACCACGCACCCAGCATTCCTACCTCACCCTTCGGTGACTCCCTGGAGTCCTCCAC 240
185P2C9v.2      TCGGGACCACGCACCCAGCATTCCTACCTCACCCTTCGGTGACTCCCTGGAGTCCTCCAC 240
185P2C9v.3      TCGGGACCACGCACCCAGCATTCCTACCTCACCCTTCGGTGACTCCCTGGAGTCCTCCAC 240
                ************************************************************

185P2C9v.1      TGAGCTCCGCCGCCACCTGCAGTTTGTAGAAGAGGAAGCGGAGTTGCTCCGGAGGTCCAT 300
185P2C9v.2      TGAGCTCCGCCGCCACCTGCAGTTTGTAGAAGAGGAAGCGGAGTTGCTCCGGAGGTCCAT 300
185P2C9v.3      TGAGCTCCGCCGCCACCTGCAGTTTGTAGAAGAGGAAGCGGAGTTGCTCCGGAGGTCCAT 300
                ************************************************************

185P2C9v.1      CTCCGAGATCGAAGACCACAACCGGCAACTGACCCACGAGCTCAGCAAGTTTAAGTTTGA 360
185P2C9v.2      CTCCGAGATCGAAGACCACAACCGGCAACTGACCCACGAGCTCAGCAAGTTTAAGTTTGA 360
185P2C9v.3      CTCCGAGATCGAAGACCACAACCGGCAACTGACCCACGAGCTCAGCAAGTTTAAGTTTGA 360
                ************************************************************

185P2C9v.1      GCCTCCCCGGGAGCCGGGCTGGCTAGGAGAGGGTGCAAGTCCTGGTGCCGGGGGTGGGGC 420
185P2C9v.2      GCCTCCCCGGGAGCCGGGCTGGCTAGGAGAGGGTGCAAGTCCTGGTGCCGGGGGTGGGGC 420
185P2C9v.3      GCCTCCCCGGGAGCCGGGCTGGCTAGGAGAGGGTGCAAGTCCTGGTGCCGGGGGTGGGGC 420
                ************************************************************

185P2C9v.1      CCCCCTGCAGGAGGAGCTGAAGTCAGCCAGGCTGCAGATCAGCGAGCTCAGCGGCAAGGT 480
185P2C9v.2      CCCCCTGCAGGAGGAGCTGAAGTCAGCCAGGCTGCAGATCAGCGAGCTCAGCGGCAAGGT 480
185P2C9v.3      CCCCCTGCAGGAGGAGCTGAAGTCAGCCAGGCTGCAGATCAGCGAGCTCAGCGGCAAGGT 480
                ************************************************************

185P2C9v.1      GCTCAAACTGCAGCACGAGAACCACGCGCTGCTGTCCAACATCCAGCGCTGCGACCTGGC 540
185P2C9v.2      GCTCAAACTGCAGCACGAGAACCACGCGCTGCTGTCCAACATCCAGCGCTGCGACCTGGC 540
185P2C9v.3      GCTCAAACTGCAGCACGAGAACCACGCGCTGCTGTCCAACATCCAGCGCTGCGACCTGGC 540
                ************************************************************
```

Figure 13n (continued)

```
185P2C9v.1      AGCCCACCTGGGGCTGCGTGCCCCCAGTCCCCGGGACAGCGATGCCGAGAGTGATGCGGG 600
185P2C9v.2      AGCCCACCTGGGGCTGCGTGCCCCCAGTCCCCGGGACAGCGATGCCGAGAGTGATGCGGG 600
185P2C9v.3      AGCCCACCTGGGGCTGCGTGCCCCCAGTCCCCGGGACAGCGATGCCGAGAGTGATGCGGG 600
                ************************************************************

185P2C9v.1      CAAGAAGGAGAGTGATGGGGAGGAGAGCCGCCTGCCCCAGCCCAAGCGGGAAGGGCCTGT 660
185P2C9v.2      CAAGAAGGAGAGTGATGGGGAGGAGAGCCGCCTGCCCCAGCCCAAGCGGGAAGGGCCTGT 660
185P2C9v.3      CAAGAAGGAGAGTGATGGGGAGGAGAGCCGCCTGCCCCAGCCCAAGTGGGAAGGGCCTGT 660
                ********************************************** *************

185P2C9v.1      TGGCGGGGAGAGTGACTCGGAGGAAATGTTTGAGAAGACGTCGGGCTTCGGGAGCGGGAA 720
185P2C9v.2      TGGCGGGGAGAGTGACTCGGAGGAGATGTTTGAGAAGACGTCGGGCTTCGGGAGCGGGAA 720
185P2C9v.3      TGGCGGGGAGAGTGACTCGGAGGAGATGTTTGAGAAGACGTCGGGCTTCGGGAGCGGGAA 720
                ************************ ***********************************

185P2C9v.1      GCCATCGGAGGCCAGCGAGCCATGCCCCACGGAGCTCCTGAAGGCCCGGGAGGACTCTGA 780
185P2C9v.2      GCCATCGGAGGCCAGCGAGCCATGCCCCACGGAGCTCCTGAAGGCCCGGGAGGACTCTGA 780
185P2C9v.3      GCCATCGGAGGCCAGCGAGCCATGCCCCACGGAGCTCCTGAAGGCCCGGGAGGACTCTGA 780
                ************************************************************

185P2C9v.1      GTACCTAGTGACCCTAAAACACGAGGCCCAGCGGCTAGAGCGGACGGTGGAGCGCCTCAT 840
185P2C9v.2      GTACCTAGTGACCCTAAAACACGAGGCCCAGCGGCTAGAGCGGACGGTGGAGCGCCTCAT 840
185P2C9v.3      GTACCTAGTGACCCTAAAACACGAGGCCCAGCGGCTAGAGCGGACGGTGGAGCGCCTCAT 840
                ************************************************************

185P2C9v.1      CACGGACACCGACAGCTTCCTCCATGATGCGGGGCTGCGGGGTGGTGCGCCCTTACCGGG 900
185P2C9v.2      CACGGACACCGACAGCTTCCTCCATGATGCGGGGCTGCGGGGTGGTGCGCCCTTACCGGG 900
185P2C9v.3      CACGGACACCGACAGCTTCCTCCATGATGCGGGGCTGCGGGGTGGTGCGCCCTTACCGGG 900
                ************************************************************

185P2C9v.1      GCCTGGCCTCCAGGGCGAAGAGGAGCAGGGTGAGGGGGACCAGCAGGAGCCCCAGCTGCT 960
185P2C9v.2      GCCTGGCCTCCAGGGCGAAGAGGAGCAGGGTGAGGGGGACCAGCAGGAGCCCCAGCTGCT 960
185P2C9v.3      GCCTGGCCTCCAGGGCGAAGAGGAGCAGGGTGAGGGGGACCAGCAGGAGCCCCAGCTGCT 960
                ************************************************************

185P2C9v.1      GGGGACCATCAACGCCAAGATGAAGGCTTTCAAGAAAGAGCTGCAGGCCTTCCTGGAGCA 1020
185P2C9v.2      GGGGACCATCAACGCCAAGATGAAGGCTTTCAAGAAAGAGCTGCAGGCCTTCCTGCAGCA 1020
185P2C9v.3      GGGGACCATCAACGCCAAGATGAAGGCTTTCAAGAAAGAGCTGCAGGCCTTCCTGGAGCA 1020
                ******************************************************* ****
```

Figure 13n (continued)

```
185P2C9v.1      GGTGAACCGCATTGGGGATGGCCTATCCCCCTTGCCCCACCTCACAGAGTCCTCTAGCTT 1080
185P2C9v.2      GGTGAACCGCATTGGGGATGGCCTATCCCCCTTGCCCCACCTCACAGAGTCCTCTAGCTT 1080
185P2C9v.3      GGTGAACCGCATTGGGGATGGCCTATCCCCCTTGCCCCACCTCACAGAGTCCTCTAGCTT 1080
                ************************************************************

185P2C9v.1      CCTCTCCACTGTGACTTCCGTGTCCCGGGACTCCCCCATCGGGAACCTGGGGAAGGAGCT 1140
185P2C9v.2      CCTCTCCACTGTGACTTCCGTGTCCCGGGACTCCCCCATCGGGAACCTGGGGAAGGAGCT 1140
185P2C9v.3      CCTCTCCACTGTGACTTCCGTGTCCCGGGACTCCCCCATCGGGAACCTGGGGAAGGAGCT 1140
                ************************************************************

185P2C9v.1      GGGCCCAGACTTGCAGTCCAGACTGAAAGAGCAGCTGGAGTGGCAGCTCGGGCCGGCCCG 1200
185P2C9v.2      GGGCCCAGACTTGCAGTCCAGACTGAAAGAGCAGCTGGAGTGGCAGCTCGGGCCGGCCCA 1200
185P2C9v.3      GGGCCCAGACTTGCAGTCCAGACTGAAAGAGCAGCTGGAGTGGCAGCTCGGGCCGGCCCG 1200
                ***********************************************************

185P2C9v.1      AGGGGACGAGCGGGAGAGCCTGCGCCTCCGAGCCGCGCGGGAGCTGCACCGCCGCGCAGA 1260
185P2C9v.2      AGGGGACGAGCGGGAGAGCCTGCGCCTCCGAGCCGCGCGGGAGCTGCACCGCCGCGCAGA 1260
185P2C9v.3      AGGGGACGAGCGGGAGAGCCTGCGCCTCCGAGCCGCGCGGGAGCTGCACCGCCGCGCAGA 1260
                ************************************************************

185P2C9v.1      CGGGGACACCGGGAGCCACGGGCTGGGAGGCCAGACCTGCTTCAGCCTGGAGATGGAGGA 1320
185P2C9v.2      CGGGGACACCGGGAGCCACGGGCTGGGAGGCCAGACCTGCTTCAGCCTGGAGATGGAGGA 1320
185P2C9v.3      CGGGGACACCGGGAGCCACGGGCTGGGAGGCCAGACCTGCTTCAGCCTGGAGATGGAGGA 1320
                ************************************************************

185P2C9v.1      GGAGCACCTCTATGCCTTGAGGTGGAAAGAACTGGAAATGCACAGCCTGGCTTTGCAAAA 1380
185P2C9v.2      GGAGCACCTCTATGCCTTGAGGTGGAAAGAACTGGAAATGCACAGCCTGGCTTTGCAAAA 1380
185P2C9v.3      GGAGCACCTCTATGCCTTGAGGTGGAAAGAACTGGAAATGCACAGCCTGGCTTTGCAAAA 1380
                ************************************************************

185P2C9v.1      CACCCTCCATGAGCGAACCTGGAGTGATGAGAAGAATCTGATGCAGCAGGAGCTCCGGTC 1440
185P2C9v.2      CACCCTCCATGAGCGAACCTGGAGTGATGAGAAGAATCTGATGCAGCAGGAGCTCCGGTC 1440
185P2C9v.3      CACCCTCCATGAGCGAACCTGGAGTGATGAGAAGAATCTGATGCAGCAGGAGCTCCGGTC 1440
                ************************************************************

185P2C9v.1      CTTGAAGCAGAACATTTTCCTCTTCTACGTCAAACTCAGGTGGCTGCTGAAACACTGGCG 1500
185P2C9v.2      CTTGAAGCAGAACATTTTCCTCTTCTACGTCAAACTCAGGTGGCTGCTGAAACACTGGCG 1500
185P2C9v.3      CTTGAAGCAGAACATTTTCCTCTTCTACGTCAAACTCAGGTGGCTGCTGAAACACTGGCG 1500
                ************************************************************
```

Figure 13n (continued)

```
185P2C9v.1      GCAAGGGAAGCAGATGGAGGAGGAAGGAGAGGAGTTCACTGAGGGTGAACATCCAGAGAC 1560
185P2C9v.2      GCAAGGGAAGCAGATGGAGGAGGAAGGAGAGGAGTTCACTGAGGGTGAACATCCAGAGAC 1560
185P2C9v.3      GCAAGGGAAGCAGATGGAGGAGGAAGGAGAGGAGTTCACTGAGGGTGAACATCCAGAGAC 1560
                ************************************************************

185P2C9v.1      CCTCTCCAGGCTCGGGGAGCTTGGAGTCCAGGGGGGTCACCAGGCGGATGGCCCAGACCA 1620
185P2C9v.2      CCTCTCCAGGCTCGGGGAGCTTGGAGTCCAGGGGGGTCACCAGGCGGATGGCCCAGACCA 1620
185P2C9v.3      CCTCTCCAGGCTCGGGGAGCTTGGAGTCCAGGGGGGTCACCAGGCGGATGGCCCAGACCA 1620
                ************************************************************

185P2C9v.1      CGACAGTGACCGAGGCTGTGGCTTTCCAGTGGGGGAGCACTCCCCACACTCCCGGGTGCA 1680
185P2C9v.2      CGACAGTGACCGAGGCTGTGGCTTTCCAGTGGGGGAGCACTCCCCACACTCCCGGGTGCA 1680
185P2C9v.3      CGACAGTGACCGAGGCTGTGGCTTTCCAGTGGGGGAGCACTCCCCACACTCCCGGGTGCA 1680
                ************************************************************

185P2C9v.1      GATTGGAGATCACAGCTTGCGGCTGCAGACCGCGGACAGGGGACAGCCCCACAAACAGGT 1740
185P2C9v.2      GATTGGAGATCACAGCTTGCGGCTGCAGACCGCGGACAGGGGACAGCCCCACAAACAGGT 1740
185P2C9v.3      GATTGGAGATCACAGCTTGCGGCTGCAGACCGCGGACAGGGGACAGCCCCACAAACAGGT 1740
                ************************************************************

185P2C9v.1      GGTGGAAAACCAGCAGCTGTTCAGCGCCTTCAAGGCCTTGCTGGAGGACTTCCGTGCGGA 1800
185P2C9v.2      GGTGGAAAACCAGCAGCTGTTCAGCGCCTTCAAGGCCTTGCTGGAGGACTTCCGTGCGGA 1800
185P2C9v.3      GGTGGAAAACCAGCAGCTGTTCAGCGCCTTCAAGGCCTTGCTGGAGGACTTCCGTGCGGA 1800
                ************************************************************

185P2C9v.1      GCTGCGGGAGGATGAGCGTGCCCGACTACGGCTGCAGCAGCAATATGCCAGCGACAAGGC 1860
185P2C9v.2      GCTGCGGGAGGATGAGCGTGCCCGACTACGGCTGCAGCAGCAATATGCCAGCGACAAGGC 1860
185P2C9v.3      GCTGCGGGAGGATGAGCGTGCCCGACTACGGCTGCAGCAGCAATATGCCAGCGACAAGGC 1860
                ************************************************************

185P2C9v.1      GGCCTGGGACGTGGAGTGGGCCGTGCTCAAGTGCCGTCTGGAACAG-------------- 1906
185P2C9v.2      GGCCTGGGACGTGGAGTGGGCCGTGCTCAAGTGCCGTCTGGAACAG-------------- 1906
185P2C9v.3      GGCCTGGGACGTGGAGTGGGCCGTGCTCAAGTGCCGTCTGGAACAGAATTGTTGTGGATA 1920
                **********************************************

185P2C9v.1      ------------------------------------------------------------
185P2C9v.2      ------------------------------------------------------------
185P2C9v.3      TCCCAGAATTAACATTGAGGAGGAGACTTTAGGCTTCACCAGGCTGCCAGCTGGGTCCAC 1980
```

Figure 13n (continued)

```
185P2C9v.1      ----------------------------------------CTGGAAGAGAAGACTGAGAA 1926
185P2C9v.2      ----------------------------------------CTGGAAGAGAAGACTGAGAA 1926
185P2C9v.3      GGTAAAAACGTTGAAGAGCCTTGGGTTGCAGAGATTGGAGCTGGAAGAGAAGACTGAGAA 2040
                                                        ********************

185P2C9v.1      CAAGTTGGGAGAACTAGGCTCCTCCGCTGAGAGCAAGGGGGCCTTGAAGAAGGAGAGAGA 1986
185P2C9v.2      CAAGTTGGGAGAACTAGGCTCCTCCGCTGAGAGCAAGGGGGCCTTGAAGAAGGAGAGAGA 1986
185P2C9v.3      CAAGTTGGGAGAACTAGGCTCCTCCGCTGAGAGCAAGGGGGCCTTGAAGAAGGAGAGAGA 2100
                ************************************************************

185P2C9v.1      GGTGCACCAGAAGCTCCTGGCAGACAGTCACAGCCTGGTCATGGACCTGCGCTGGCAGAT 2046
185P2C9v.2      GGTGCACCAGAAGCTCCTGGCAGACAGTCACAGCCTGGTCATGGACCTGCGCTGGCAGAT 2046
185P2C9v.3      GGTGCACCAGAAGCTCCTGGCAGACAGTCACAGCCTGGTCATGGACCTGCGCTGGCAGAT 2160
                ************************************************************

185P2C9v.1      CCATCACAGCGAGAAGAACTGGAACCGGGAGAAGGTGGAACTTCTCGACCGCCTGGACAG 2106
185P2C9v.2      CCATCACAGCGAGAAGAACTGGAACCGGGAGAAGGTGGAACTTCTCGACCGCCTGGACAG 2106
185P2C9v.3      CCATCACAGCGAGAAGAACTGGAACCGGGAGAAGGTGGAACTTCTCGACCGCCTGGACAG 2220
                ************************************************************

185P2C9v.1      AGATCGGCAGGAGTGGGAGCGGCAGAAGAAGGAATTCTTGTGGAGGATAGAGCAGTTGCA 2166
185P2C9v.2      AGATCGGCAGGAGTGGGAGCGGCAGAAGAAGGAATTCTTGTGGAGGATAGAGCAGTTGCA 2166
185P2C9v.3      AGATCGGCAGGAGTGGGAGCGGCAGAAGAAGGAATTCTTGTGGAGGATAGAGCAG----- 2275
                *******************************************************

185P2C9v.1      GAAAGAGAACAGTCCCCGGAGAGGTGGCAGTTTCCTCTGTGATCAAAAAGACGGCAACGT 2226
185P2C9v.2      GAAAGAGAACAGTCCCCGGAGAGGTGGCAGTTTCCTCTGTGATCAAAAAGACGGCAACGT 2226
185P2C9v.3      ------------------------------------------------------------

185P2C9v.1      TCGCCCCTTTCCCCACCAGGGAAGCCTCCGCATGCCCCGTCCAGTGGCCATGTGGCCTTG 2286
185P2C9v.2      TCGCCCCTTTCCCCACCAGGGAAGCCTCCGCATGCCCCGTCCAGTGGCCATGTGGCCTTG 2286
185P2C9v.3      -------------------GGAAGCCTCCGCATGCCCCGTCCAGTGGCCATGTGGCCTTG 2316
                                   *****************************************

185P2C9v.1      TGCAGATGCTGACTCCATCCCGTTTGAAGACCGGCCGCTGTCCAAGCTGAAGGAGTCGGA 2346
185P2C9v.2      TGCAGATGCTGACTCCATCCCGTTTGAAGACCGGCCGCTGTCCAAGCTGAAGGAGTCGGA 2346
185P2C9v.3      TGCAGATGCTGACTCCATCCCGTTTGAAGACCGGCCGCTGTCCAAGCTGAAGGAGTCGGA 2376
                ************************************************************
```

Figure 13n (continued)

```
185P2C9v.1      CAGGTGCTCGGCCAGTGAGAATCTCTACCTGGATGCCTTGTCCCTGGATGACGAGCCAGA 2406
185P2C9v.2      CAGGTGCTCGGCCAGTGAGAATCTCTACCTGGATGCCTTGTCCCTGGATGACGAGCCAGA 2406
185P2C9v.3      CAGGTGCTCGGCCAGTGAGAATCTCTACCTGGATGCCTTGTCCCTGGATGACGAGCCAGA 2436
                ************************************************************

185P2C9v.1      AGAGCCACCAGCCCACAGGCCCGAGAGGGAGTTCAGGAACCGCCTCCCTGAGGAAGAAGA 2466
185P2C9v.2      AGAGCCACCAGCCCACAGGCCCGAGAGGGAGTTCAGGAACCGCCTCCCTGAGGAAGAAGA 2466
185P2C9v.3      AGAGCCACCAGCCCACAGGCCCGAGAGGGAGTTCAGGAACCGCCTCCCTGAGGAAGAAGA 2496
                ************************************************************

185P2C9v.1      AAATCACAAAGGAAATCTTCAAAGGGCGGTGTCCGTGTCCTCCATGTCTGAGTTCCAGCG 2526
185P2C9v.2      AAATCACAAAGGAAATCTTCAAAGGGCGGTGTCCGTGTCCTCCATGTCTGAGTTCCAGCG 2526
185P2C9v.3      AAATCACAAAGGAAATCTTCAAAGGGCGGTGTCCGTGTCCTCCATGTCTGAGTTCCAGCG 2556
                ************************************************************

185P2C9v.1      TCTAATGGACATCTCCCCCTTCCTGCCTGAGAAGGGCCTGCCGTCCACCAGCAGCAAGGA 2586
185P2C9v.2      TCTAATGGACATCTCCCCCTTCCTGCCTGAGAAGGGCCTGCCGTCCACCAGCAGCAAGGA 2586
185P2C9v.3      TCTAATGGACATCTCCCCCTTCCTGCCTGAGAAGGGCCTGCCGTCCACCAGCAGCAAGGA 2616
                ************************************************************

185P2C9v.1      GGATGTCACCCCACCCCTGTCTCCAGACGACCTCAAGTACATCGAGGAGTTCAACAAGAG 2646
185P2C9v.2      GGATGTCACCCCACCCCTGTCTCCAGACGACCTCAAGTACATCGAGGAGTTCAACAAGAG 2646
185P2C9v.3      GGATGTCACCCCACCCCTGTCTCCAGACGACCTCAAGTACATCGAGGAGTTCAACAAGAG 2676
                ************************************************************

185P2C9v.1      CTGGGACTACACACCCAACAGGGGCCACAATGGTGGGGGCCGGACCTTTGGCCGACAG 2706
185P2C9v.2      CTGGGACTACACACCCAACAGGGGCCACAATGGTGGGGGCCGGACCTTTGGCCGACAG 2706
185P2C9v.3      CTGGGACTACACACCCAACAGGGGCCACAATGGTGGGGGCCGGACCTTTGGCCGACAG 2736
                ************************************************************

185P2C9v.1      GACCGAGGTGGGGCGGGCAGGGCACGAGGACAGCACAGAGCCTTTCCCCGACTCCTCCTG 2766
185P2C9v.2      GACCGAGGTGGGGCGGGCAGGGCACGAGGACAGCACAGAGCCTTTCCCCGACTCCTCCTG 2766
185P2C9v.3      GACCGAGGTGGGGCGGGCAGGGCACGAGGACAGCACAGAGCCTTTCCCCGACTCCTCCTG 2796
                ************************************************************

185P2C9v.1      GTACCTAACCACAAGTGTCACCATGACCACGGACACCATGACCAGCCCAGAGCACTGCCA 2826
185P2C9v.2      GTACCTAACCACAAGTGTCACCATGACCACGGACACCATGACCAGCCCAGAGCACTGCCA 2826
185P2C9v.3      GTACCTAACCACAAGTGTCACCATGACCACGGACACCATGACCAGCCCAGAGCACTGCCA 2856
                ************************************************************
```

Figure 13n (continued)

```
185P2C9v.1      GAAGCAGCCACTGCGGAGCCACGTCCTCACCGAGCAGTCGGGGTTGCGCGTGTTACACAG 2886
185P2C9v.2      GAAGCAGCCACTGCGGAGCCACGTCCTCACCGAGCAGTCGGGGTTGCGCGTGTTACACAG 2886
185P2C9v.3      GAAGCAGCCACTGCGGAGCCACGTCCTCACCGAGCAGTCGGGGTTGCGCGTGTTACACAG 2916
                ************************************************************

185P2C9v.1      CCCGCCTGCCGTGCGCAGGGTCGACAGCATCACGGCGGCAGGTGGTGAGGGTCCCTTTCC 2946
185P2C9v.2      CCCGCCTGCCGTGCGCAGGGTCGACAGCATCACGGCGGCAGGTGGTGAGGGTCCCTTTCC 2946
185P2C9v.3      CCCGCCTGCCGTGCGCAGGGTCGACAGCATCACGGCGGCAGGTGGTGAGGGTCCCTTTCC 2976
                ************************************************************

185P2C9v.1      CACAAGCAGAGCCAGAGGGAGCCCGGGAGACACCAAGGGGGGCCCTCCAGAACCCATGCT 3006
185P2C9v.2      CACAAGCAGAGCCAGAGGGAGCCCGGGAGACACCAAGGGGGGCCCTCCAGAACCCATGCT 3006
185P2C9v.3      CACAAGCAGAGCCAGAGGGAGCCCGGGAGACACCAAGGGGGGCCCTCCAGAACCCATGCT 3036
                ************************************************************

185P2C9v.1      CAGCAGGTGGCCTTGCACCTCCCCCAGGCACTCCCGGGACTATGTGGAGGGGGCACGGCG 3066
185P2C9v.2      CAGCAGGTGGCCTTGCACCTCCCCCAGGCACTCCCGGGACTATGTGGAGGGGGCACGGCG 3066
185P2C9v.3      CAGCAGGTGGCCTTGCACCTCCCCCAGGCACTCCCGGGACTATGTGGAGGGGGCACGGCG 3096
                ************************************************************

185P2C9v.1      CCCCCTTGATAGTCCCCTCTGTACCTCCCTGGGGTTTGCCTCCCCACTGCACAGCCTGGA 3126
185P2C9v.2      CCCCCTTGATAGTCCCCTCTGTACCTCCCTGGGGTTTGCCTCCCCACTGCACAGCCTGGA 3126
185P2C9v.3      CCCCCTTGATAGTCCCCTCTGTACCTCCCTGGGGTTTGCCTCCCCACTGCACAGCCTGGA 3156
                ************************************************************

185P2C9v.1      GATGTCCAAGAACTTGAGTGATGACATGAAGGAGGTGGCCTTCTCTGTCAGGAATGCCAT 3186
185P2C9v.2      GATGTCCAAGAACTTGAGTGATGACATGAAGGAGGTGGCCTTCTCTGTCAGGAATGCCAT 3186
185P2C9v.3      GATGTCCAAGAACTTGAGTGATGACATGAAGGAGGTGGCCTTCTCTGTCAGGAATGCCAT 3216
                ************************************************************

185P2C9v.1      CTGCTCCGGCCCTGGCGAGCTGCAAGTCAAGGACATGGCCTGCCAGACCAATGGGTCCCG 3246
185P2C9v.2      CTGCTCCGGCCCTGGCGAGCTGCAAGTCAAGGACATGGCCTGCCAGACCAATGGGTCCCG 3246
185P2C9v.3      CTGCTCCGGCCCTGGCGAGCTGCAAGTCAAGGACATGGCCTGCCAGACCAATGGGTCCCG 3276
                ************************************************************

185P2C9v.1      GACGATGGGGACCCAGACTGTTCAGACCATCAGTGTGGGCTTGCAGACTGAAGCCCTGCG 3306
185P2C9v.2      GACGATGGGGACCCAGACTGTTCAGACCATCAGTGTGGGCTTGCAGACTGAAGCCCTGCG 3306
185P2C9v.3      GACGATGGGGACCCAGACTGTTCAGACCATCAGTGTGGGCTTGCAGACTGAAGCCCTGCG 3336
                ************************************************************
```

Figure 13n (continued)

```
185P2C9v.1      TGGCAGCGGTGTCACCAGCAGCCCCCACAAGTGTCTCACTCCAAAGGCTGGGGGCGGTGC 3366
185P2C9v.2      TGGCAGCGGTGTCACCAGCAGCCCCCACAAGTGTCTCACTCCAAAGGCTGGGGGCGGTGC 3366
185P2C9v.3      TGGCAGCGGTGTCACCAGCAGCCCCCACAAGTGTCTCACTCCAAAGGCTGGGGGCGGTGC 3396
                ************************************************************

185P2C9v.1      TACACCCGTGTCGTCTCCTTCCCGGAGCCTTAGGAGCAGACAGGTGGCCCCTGCCATCGA 3426
185P2C9v.2      TACACCCGTGTCGTCTCCTTCCCGGAGCCTTAGGAGCAGACAGGTGGCCCCTGCCATCGA 3426
185P2C9v.3      TACACCCGTGTCGTCTCCTTCCCGGAGCCTTAGGAGCAGACAGGTGGCCCCTGCCATCGA 3456
                ************************************************************

185P2C9v.1      GAAGGTGCAGGCCAAGTTTGAACGCACATGCTGCTCCCCCAAGTATGGTTCTCCCAAGCT 3486
185P2C9v.2      GAAGGTGCAGGCCAAGTTTGAACGCACATGCTGCTCCCCCAAGTATGGTTCTCCCAAGCT 3486
185P2C9v.3      GAAGGTGCAGGCCAAGTTTGAACGCACATGCTGCTCCCCCAAGTATGGTTCTCCCAAGCT 3516
                ************************************************************

185P2C9v.1      GCAGAGGAAGCCCCTCCCCAAAGCCGACCAGCCAAATAACAGGACGTCACCAGGGATGGC 3546
185P2C9v.2      GCAGAGGAAGCCCCTCCCCAAAGCCGACCAGCCAAATAACAGG----------------- 3529
185P2C9v.3      GCAGAGGAAGCCCCTCCCCAAAGCCGACCAGCCAAATAACAGGACGTCACCAGGGATGGC 3576
                *******************************************

185P2C9v.1      CCAGAAAGGGTACAGTGAGTCAGCCTGGGCCCGCTCCACCACCACAAGGGAGAGCCCCGT 3606
185P2C9v.2      ------------------------------------------------------------
185P2C9v.3      CCAGAAAGGGTACAGTGAGTCAGCCTGGGCCCGCTCCACCACCACAAGGGAGAGCCCCGT 3636

185P2C9v.1      GCACACCACCATTAATGATGGCCTCTCCAGCCTCTTCAACATCATTGACCACAGCCCCGT 3666
185P2C9v.2      ------------------------------------------------------------
185P2C9v.3      GCACACCACCATTAATGATGGCCTCTCCAGCCTCTTCAACATCATTGACCACAGCCCCGT 3696

185P2C9v.1      GGTGCAGGACCCCTTCCAGAAGGGGCTGCGGGCCGGCAGTCGGTCTCGCTCAGCAGAGCC 3726
185P2C9v.2      ------------------------------------------------------------
185P2C9v.3      GGTGCAGGACCCCTTCCAGAAGGGGCTGCGGGCCGGCAGTCGGTCTCGCTCAGCAGAGCC 3756

185P2C9v.1      CCGACCAGAGCTGGGCCCAGGCCAGGAAACAGGCACCAATTCCCGAGGAAGGTCGCCTAG 3786
185P2C9v.2      ---------------------CCAGGAAACAGGCACCAATTCCCGAGGAAGGTCGCCTAG 3568
185P2C9v.3      CCGACCAGAGCTGGGCCCAGGCCAGGAAACAGGCACCAATTCCCGAGGAAGGTCGCCTAG 3816
                                     ***************************************
```

Figure 13n (continued)

```
185P2C9v.1      CCCCATTGGGGTGGGGTCAGAGATGTGCAGGGAGGAAGGGGGAGAGGGCACGCCAGTGAA 3846
185P2C9v.2      CCCCATTGGGGTGGGGTCAGAGATGTGCAGGGAGGAAGGGGGAGAGGGCACGCCAGTGAA 3628
185P2C9v.3      CCCCATTGGGGTGGGGTCAGAGATGTGCAGGGAGGAAGGGGGAGAGGGCACGCCAGTGAA 3876
                ************************************************************

185P2C9v.1      GCAGGACTTATCTGCTCCCCCTGGCTACACCCTCACTGAGAACGTGGCCCGGATCCTCAA 3906
185P2C9v.2      GCAGGACTTATCTGCTCCCCCTGGCTACACCCTCACTGAGAACGTGGCCCGGATCCTCAA 3688
185P2C9v.3      GCAGGACTTATCTGCTCCCCCTGGCTACACCCTCACTGAGAACGTGGCCCGGATCCTCAA 3936
                ************************************************************

185P2C9v.1      CAAGAAGCTGCTGGAACATGCCTTAAAGGAGGAGAGGAGGCAGGCTGCCCACGGGCCCCC 3966
185P2C9v.2      CAAGAAGCTGCTGGAACATGCCTTAAAGGAGGAGAGGAGGCAGGCTGCCCACGGGCCCCC 3748
185P2C9v.3      CAAGAAGCTGCTGGAACATGCCTTAAAGGAGGAGAGGAGGCAGGCTGCCCACGGGCCCCC 3996
                ************************************************************

185P2C9v.1      GGGTCTCCACAGTGACAGCCACTCGCTGGGGGACACAGCCGAGCCAGGGCCCATGGAGAA 4026
185P2C9v.2      GGGTCTCCACAGTGACAGCCACTCGCTGGGGGACACAGCCGAGCCAGGGCCCATGGAG-- 3806
185P2C9v.3      GGGTCTCCACAGTGACAGCCACTCGCTGGGGGACACAGCCGAGCCAGGGCCCATGGAG-- 4054
                **********************************************************

185P2C9v.1      CCAAACTGTCTTGCTAACTGCCCCCTGGGGACTCTAGCCCTGCCCGCCTCACGCTGAACT 4086
185P2C9v.2      -------------------------------------------------------GAACT 3811
185P2C9v.3      -------------------------------------------------------GAACT 4059
                                                                       *****

185P2C9v.1      ACCTTGTTCTGCACTAGCTCCATCCCTAGAGCCCTGCTTCTCCAGGCCCGAGAGACCAGC 4146
185P2C9v.2      ACCTTGTTCTGCACTAGCTCCATCCCTAGAGCCCTGCTTCTCCAGGCCCGAGAGACCAGC 3871
185P2C9v.3      ACCTTGTTCTGCACTAGCTCCATCCCTAGAGCCCTGCTTCTCCAGGCCCGAGAGACCAGC 4119
                ************************************************************

185P2C9v.1      AAACCGTCGCCCTCCGTCCCGTTGGGCCCCACATTCCCCCACTGCCTCACAGCCTCAGTC 4206
185P2C9v.2      AAACCGTCGCCCTCCGTCCCGTTGGGCCCCACATTCCCCCACTGCCTCACAGCCTCAGTC 3931
185P2C9v.3      AAACCGTCGCCCTCCGTCCCGTTGGGCCCCACATTCCCCCACTGCCTCACAGCCTCAGTC 4179
                ************************************************************

185P2C9v.1      ACCCGGAGACCCGACGTCCTTGGAGGAGCATGGTGGCGAGGAGCCGCCCGAGGAGCAGCC 4266
185P2C9v.2      ACCCGGAGACCCGACGTCCTTGGAGGAGCATGGTGGCGAGGAGCCGCCCGAGGAGCAGCC 3991
185P2C9v.3      ACCCGGAGACCCGACGTCCTTGGAGGAGCATGGTGGCGAGGAGCCGCCCGAGGAGCAGCC 4239
                ************************************************************
```

Figure 13n (continued)

```
185P2C9v.1      ACACCGAGATGCAAGCTTGCATGGATTATCACAGTATAATTCACTGTAATTTGCATAACC 4326
185P2C9v.2      ACACCGAGATGCAAGCTTGCATGGATTATCACAGTATAATTCACTGTAATTTGCATAACC 4051
185P2C9v.3      ACACCGAGATGCAAGCTTGCATGGATTATCACAGTATAATTCACTGTAATTTGCATAACC 4299
                ************************************************************

185P2C9v.1      ACACCATCACCATGAACAAAACTCTGCCCAACAGGAGAGATCTAGTTTTCTCAAGGTCAA 4386
185P2C9v.2      ACACCATCACCATGAACAAAACTCTGCCCAACAGGAGAGATCTAGTTTTCTCAAGGTCAA 4111
185P2C9v.3      ACACCATCACCATGAACAAAACTCTGCCCAACAGGAGAGATCTAGTTTTCTCAAGGTCAA 4359
                ************************************************************

185P2C9v.1      AGAATGTTTTTTAAAAACACAAAGCTGCTGAATGTTCAACCTGTGAAACTGAGATGTTTC 4446
185P2C9v.2      AGAATGTTTTTTAAAAACACAAAGCTGCTGAATGTTCAACCTGTGAAACTGAGATGTTTC 4171
185P2C9v.3      AGAATGTTTTTTAAAAACACAAAGCTGCTGAATGTTCAACCTGTGAAACTGAGATGTTTC 4419
                ************************************************************

185P2C9v.1      TAGAATGAAACAGTAAATGTGCCTGTAATAACTTAATTTTTTTCATAGCTCAGAAAACTA 4506
185P2C9v.2      TAGAATGAAACAGTAAATGTGCCTGTAATAACTTAATTTTTTTCATAGCTCAGAAAACTA 4231
185P2C9v.3      TAGAATGAAACAGTAAATGTGCCTGTAATAACTTAATTTTTTTCATAGCTCAGAAAACTA 4479
                ************************************************************

185P2C9v.1      TTTTTGTCTCCATCTTTTTTACACACAGTATATTAAACGAAAAGGTAAATAAGGTATAAA 4566
185P2C9v.2      TTTTTGTCTCCATCTTTTTTACACACAGTATATTAAACGAAAAGGTAAATAAGGTATAAA 4291
185P2C9v.3      TTTTTGTCTCCATCTTTTTTACACACAGTATATTAAACGAAAAGGTAAATAAGGTATAAA 4539
                ************************************************************

185P2C9v.1      TAGATTTAAAAAATAAAAGTTTTAAAAAATGTACATTTTAAGAGATTCTGAACACCCTCG 4626
185P2C9v.2      TAGATTTAAAAAATAAAAGTTTTAAAAAATGTACATTTTAAGAGATTCTGAACACCCTCG 4351
185P2C9v.3      TAGATTTAAAAAATAAAAGTTTTAAAAAATGTACATTTTAAGAGATTCTGAACACCCTCG 4599
                ************************************************************

185P2C9v.1      CTGTCAATACCTGACTGCCTCTGTTAAATTTGCACTGTTACATTTTGGTTCAGTTTATTT 4686
185P2C9v.2      CTGTCAATACCTGACTGCCTCTGTTAAATTTGCACTGTTACATTTTGGTTCAGTTTATTT 4411
185P2C9v.3      CTGTCAATACCTGACTGCCTCTGTTAAATTTGCACTGTTACATTTTGGTTCAGTTTATTT 4659
                ************************************************************

185P2C9v.1      CCATGTTGAATTAGAGTGGATTAAGTTAATTTTATTTTGTCAGTGTTACTGTTTTTTACG 4746
185P2C9v.2      CCATGTTGAATTAGAGTGGATTAAGTTAATTTTATTTTGTCAGTGTTACTGTTTTTTACG 4471
185P2C9v.3      CCATGTTGAATTAGAGTGGATTAAGTTAATTTTATTTTGTCAGTGTTACTGTTTTTTACG 4719
                ************************************************************
```

Figure 13n (continued)

```
185P2C9v.1      AATTTTTTAATGCTTCAGACTGTCTGATTCAGTGAACTTTTTGTAGTGAAAAAGCCATGA 4806
185P2C9v.2      AATTTTTTAATGCTTCAGACTGTCTGATTCAGTGAACTTTTTGTAGTGAAAAAGCCATGA 4531
185P2C9v.3      AATTTTTTAATGCTTCAGACTGTCTGATTCAGTGAACTTTTTGTAGTGAAAAAGCCATGA 4779
                ************************************************************

185P2C9v.1      AGCCAGTAGACAAGACAGATATTCTGTATGCTGGAGGGGATACAGGATGATTTTGAAAAG 4866
185P2C9v.2      AGCCAGTAGACAAGACAGATATTCTGTATGCTGGAGGGGATACAGGATGATTTTGAAAAG 4591
185P2C9v.3      AGCCAGTAGACAAGACAGATATTCTGTATGCTGGAGGGGATACAGGATGATTTTGAAAAG 4839
                ************************************************************

185P2C9v.1      GTACAAAGTCCTCAGTGGGCTTAGAAAATTCACTGTATGATCCTTATATTATCCTACTTG 4926
185P2C9v.2      GTACAAAGTCCTCAGTGGGCTTAGAAAATTCACTGTATGATCCTTATATTATCCTACTTG 4651
185P2C9v.3      GTACAAAGTCCTCAGTGGGCTTAGAAAATTCACTGTATGATCCTTATATTATCCTACTTG 4899
                ************************************************************

185P2C9v.1      GCTTGCACGTCTTCGGGTGCATGTATATACCGCTACTGTGTCCTCGCCATCACCTAAATG 4986
185P2C9v.2      GCTTGCACGTCTTCGGGTGCATGTATATACCGCTACTGTGTCCTCGCCATCACCTAAATG 4711
185P2C9v.3      GCTTGCACGTCTTCGGGTGCATGTATATACCGCTACTGTGTCCTCGCCATCACCTAAATG 4959
                ************************************************************

185P2C9v.1      TGACTCAGTCTGTTCCACTGTAATATGTTGTGAATTTCCTTGTACTGTACTTTTATTGTT 5046
185P2C9v.2      TGACTCAGTCTGTTCCACTGTAATATGTTGTGAATTTCCTTGTACTGTACTTTTATTGTT 4771
185P2C9v.3      TGACTCAGTCTGTTCCACTGTAATATGTTGTGAATTTCCTTGTACTGTACTTTTATTGTT 5019
                ************************************************************

185P2C9v.1      GGTCTTCTTGCATCGATGATCCAACAGCAACACCATTTTTAAATTATTGTGAAAAGATTA 5106
185P2C9v.2      GGTCTTCTTGCATCGATGATCCAACAGCAACACCATTTTTAAATTATTGTGAAAAGATTA 4831
185P2C9v.3      GGTCTTCTTGCATCGATGATCCAACAGCAACACCATTTTTAAATTATTGTGAAAAGATTA 5079
                ************************************************************

185P2C9v.1      ACTGGCAATGTACAGAGTTTACTCAAAGTTTTCTTAAGGGAAAACACTACAAAAAGTCAC 5166
185P2C9v.2      ACTGGCAATGTACAGAGTTTACTCAAAGTTTTCTTAAGGGAAAACACTACAAAAAGTCAC 4891
185P2C9v.3      ACTGGCAATGTACAGAGTTTACTCAAAGTTTTCTTAAGGGAAAACACTACAAAAAGTCAC 5139
                ************************************************************

185P2C9v.1      AAGGATACCAAATGGAAACACATGATGATGCCTCTGGGTCTGTATGAGACCGTGATGAAG 5226
185P2C9v.2      AAGGATACCAAATGGAAACACATGATGATGCCTCTGGGTCTGTATGAGACCGTGATGAAG 4951
185P2C9v.3      AAGGATACCAAATGGAAACACATGATGATGCCTCTGGGTCTGTATGAGACCGTGATGAAG 5199
                ************************************************************
```

Figure 13n (continued)

```
185P2C9v.1      TAGAAATAAAGCCCTTCTGAGATGGC 5252
185P2C9v.2      TAGAAATAAAGCCCTTCTGAGATGGC 4977
185P2C9v.3      TAGAAATAAAGCCCTTCTGAGATGGC 5225
                **************************
```

Figure 14n Alignment of protein sequences of 185P2C9 transcript variants (SEQ ID NOS:48, 159, 160).

```
185P2C9v.1      MEDTRGQQEREGPGRDHAPSIPTSPFGDSLESSTELRRHLQFVEEEAELLRRSISEIEDH 60
185P2C9v.2      MEDTRGQQEREGPGRDHAPSIPTSPFGDSLESSTELRRHLQFVEEEAELLRRSISEIEDH 60
185P2C9v.3      MEDTRGQQEREGPGRDHAPSIPTSPFGDSLESSTELRRHLQFVEEEAELLRRSISEIEDH 60
                ************************************************************

185P2C9v.1      NRQLTHELSKFKFEPPREPGWLGEGASPGAGGGAPLQEELKSARLQISELSGKVLKLQHE 120
185P2C9v.2      NRQLTHELSKFKFEPPREPGWLGEGASPGAGGGAPLQEELKSARLQISELSGKVLKLQHE 120
185P2C9v.3      NRQLTHELSKFKFEPPREPGWLGEGASPGAGGGAPLQEELKSARLQISELSGKVLKLQHE 120
                ************************************************************

185P2C9v.1      NHALLSNIQRCDLAAHLGLRAPSPRDSDAESDAGKKESDGEESRLPQPKREGPVGGESDS 180
185P2C9v.2      NHALLSNIQRCDLAAHLGLRAPSPRDSDAESDAGKKESDGEESRLPQPKREGPVGGESDS 180
185P2C9v.3      NHALLSNIQRCDLAAHLGLRAPSPRDSDAESDAGKKESDGEESRLPQPKWEGPVGGESDS 180
                ************************************************* **********

185P2C9v.1      EEMFEKTSGFGSGKPSEASEPCPTELLKAREDSEYLVTLKHEAQRLERTVERLITDTDSF 240
185P2C9v.2      EEMFEKTSGFGSGKPSEASEPCPTELLKAREDSEYLVTLKHEAQRLERTVERLITDTDSF 240
185P2C9v.3      EEMFEKTSGFGSGKPSEASEPCPTELLKAREDSEYLVTLKHEAQRLERTVERLITDTDSF 240
                ************************************************************

185P2C9v.1      LHDAGLRGGAPLPGPGLQGEEEQGEGDQQEPQLLGTINAKMKAFKKELQAFLEQVNRIGD 300
185P2C9v.2      LHDAGLRGGAPLPGPGLQGEEEQGEGDQQEPQLLGTINAKMKAFKKELQAFLQQVNRIGD 300
185P2C9v.3      LHDAGLRGGAPLPGPGLQGEEEQGEGDQQEPQLLGTINAKMKAFKKELQAFLEQVNRIGD 300
                ****************************************************:*******

185P2C9v.1      GLSPLPHLTESSSFLSTVTSVSRDSPIGNLGKELGPDLQSRLKEQLEWQLGPARGDERES 360
185P2C9v.2      GLSPLPHLTESSSFLSTVTSVSRDSPIGNLGKELGPDLQSRLKEQLEWQLGPAQGDERES 360
185P2C9v.3      GLSPLPHLTESSSFLSTVTSVSRDSPIGNLGKELGPDLQSRLKEQLEWQLGPARGDERES 360
                *****************************************************:******
```

Figure 14n (continued)

```
185P2C9v.1      LRLRAARELHRRADGDTGSHGLGGQTCFSLEMEEEHLYALRWKELEMHSLALQNTLHERT 420
185P2C9v.2      LRLRAARELHRRADGDTGSHGLGGQTCFSLEMEEEHLYALRWKELEMHSLALQNTLHERT 420
185P2C9v.3      LRLRAARELHRRADGDTGSHGLGGQTCFSLEMEEEHLYALRWKELEMHSLALQNTLHERT 420
                ************************************************************

185P2C9v.1      WSDEKNLMQQELRSLKQNIFLFYVKLRWLLKHWRQGKQMEEEGEEFTEGEHPETLSRLGE 480
185P2C9v.2      WSDEKNLMQQELRSLKQNIFLFYVKLRWLLKHWRQGKQMEEEGEEFTEGEHPETLSRLGE 480
185P2C9v.3      WSDEKNLMQQELRSLKQNIFLFYVKLRWLLKHWRQGKQMEEEGEEFTEGEHPETLSRLGE 480
                ************************************************************

185P2C9v.1      LGVQGGHQADGPDHDSDRGCGFPVGEHSPHSRVQIGDHSLRLQTADRGQPHKQVVENQQL 540
185P2C9v.2      LGVQGGHQADGPDHDSDRGCGFPVGEHSPHSRVQIGDHSLRLQTADRGQPHKQVVENQQL 540
185P2C9v.3      LGVQGGHQADGPDHDSDRGCGFPVGEHSPHSRVQIGDHSLRLQTADRGQPHKQVVENQQL 540
                ************************************************************

185P2C9v.1      FSAFKALLEDFRAELREDERARLRLQQQYASDKAAWDVEWAVLKCRLEQ----------- 589
185P2C9v.2      FSAFKALLEDFRAELREDERARLRLQQQYASDKAAWDVEWAVLKCRLEQ----------- 589
185P2C9v.3      FSAFKALLEDFRAELREDERARLRLQQQYASDKAAWDVEWAVLKCRLEQNCCGYPRINIE 600
                *************************************************

185P2C9v.1      ---------------------------LEEKTENKLGELGSSAESKGALKKEREVHQKLL 622
185P2C9v.2      ---------------------------LEEKTENKLGELGSSAESKGALKKEREVHQKLL 622
185P2C9v.3      EETLGFTRLPAGSTVKTLKSLGLQRLELEEKTENKLGELGSSAESKGALKKEREVHQKLL 660
                                           *********************************

185P2C9v.1      ADSHSLVMDLRWQIHHSEKNWNREKVELLDRLDRDRQEWERQKKEFLWRIEQLQKENSPR 682
185P2C9v.2      ADSHSLVMDLRWQIHHSEKNWNREKVELLDRLDRDRQEWERQKKEFLWRIEQLQKENSPR 682
185P2C9v.3      ADSHSLVMDLRWQIHHSEKNWNREKVELLDRLDRDRQEWERQKKEFLWRIE--------- 711
                ***************************************************

185P2C9v.1      RGGSFLCDQKDGNVRPFFHQGSLRMPRPVAMWPCADADSIPFEDRPLSKLKESDRCSASE 742
185P2C9v.2      RGGSFLCDQKDGNVRPFFHQGSLRMPRPVAMWPCADADSIPFEDRPLSKLKESDRCSASE 742
185P2C9v.3      -------------------QGSLRMPRPVAMWPCADADSIPFEDRPLSKLKESDRCSASE 752
                                   *****************************************

185P2C9v.1      NLYLDALSLDDEPEEPPAHRPEREFRNRLPEEEENHKGNLQRAVSVSSMSEFQRLMDISP 802
185P2C9v.2      NLYLDALSLDDEPEEPPAHRPEREFRNRLPEEEENHKGNLQRAVSVSSMSEFQRLMDISP 802
185P2C9v.3      NLYLDALSLDDEPEEPPAHRPEREFRNRLPEEEENHKGNLQRAVSVSSMSEFQRLMDISP 812
                ************************************************************
```

Figure 14n (continued)

```
185P2C9v.1      FLPEKGLPSTSSKEDVTPPLSPDDLKYIEEFNKSWDYTPNRGHNGGGPDLWADRTEVGRA 862
185P2C9v.2      FLPEKGLPSTSSKEDVTPPLSPDDLKYIEEFNKSWDYTPNRGHNGGGPDLWADRTEVGRA 862
185P2C9v.3      FLPEKGLPSTSSKEDVTPPLSPDDLKYIEEFNKSWDYTPNRGHNGGGPDLWADRTEVGRA 872
                ************************************************************

185P2C9v.1      GHEDSTEPFPDSSWYLTTSVTMTTDTMTSPEHCQKQPLRSHVLTEQSGLRVLHSPPAVRR 922
185P2C9v.2      GHEDSTEPFPDSSWYLTTSVTMTTDTMTSPEHCQKQPLRSHVLTEQSGLRVLHSPPAVRR 922
185P2C9v.3      GHEDSTEPFPDSSWYLTTSVTMTTDTMTSPEHCQKQPLRSHVLTEQSGLRVLHSPPAVRR 932
                ************************************************************

185P2C9v.1      VDSITAAGGEGPFPTSRARGSPGDTKGGPPEPMLSRWPCTSPRHSRDYVEGARRPLDSPL 982
185P2C9v.2      VDSITAAGGEGPFPTSRARGSPGDTKGGPPEPMLSRWPCTSPRHSRDYVEGARRPLDSPL 982
185P2C9v.3      VDSITAAGGEGPFPTSRARGSPGDTKGGPPEPMLSRWPCTSPRHSRDYVEGARRPLDSPL 992
                ************************************************************

185P2C9v.1      CTSLGFASPLHSLEMSKNLSDDMKEVAFSVRNAICSGPGELQVKDMACQTNGSRTMGTQT 1042
185P2C9v.2      CTSLGFASPLHSLEMSKNLSDDMKEVAFSVRNAICSGPGELQVKDMACQTNGSRTMGTQT 1042
185P2C9v.3      CTSLGFASPLHSLEMSKNLSDDMKEVAFSVRNAICSGPGELQVKDMACQTNGSRTMGTQT 1052
                ************************************************************

185P2C9v.1      VQTISVGLQTEALRGSGVTSSPHKCLTPKAGGGATPVSSPSRSLRSRQVAPAIEKVQAKF 1102
185P2C9v.2      VQTISVGLQTEALRGSGVTSSPHKCLTPKAGGGATPVSSPSRSLRSRQVAPAIEKVQAKF 1102
185P2C9v.3      VQTISVGLQTEALRGSGVTSSPHKCLTPKAGGGATPVSSPSRSLRSRQVAPAIEKVQAKF 1112
                ************************************************************

185P2C9v.1      ERTCCSPKYGSPKLQRKPLPKADQPNNRTSPGMAQKGYSESAWARSTTTRESPVHTTIND 1162
185P2C9v.2      ERTCCSPKYGSPKLQRKPLPKADQPNN--------------------------------- 1129
185P2C9v.3      ERTCCSPKYGSPKLQRKPLPKADQPNNRTSPGMAQKGYSESAWARSTTTRESPVHTTIND 1172
                ***************************

185P2C9v.1      GLSSLFNIIDHSPVVQDPFQKGLRAGSRSRSAEPRPELGPGQETGTNSRGRSPSPIGVGS 1222
185P2C9v.2      -----------------------RPGNR-------------------------------- 1134
185P2C9v.3      GLSSLFNIIDHSPVVQDPFQKGLRAGSRSRSAEPRPELGPGQETGTNSRGRSPSPIGVGS 1232
                                       * * *

185P2C9v.1      EMCREEGGEGTPVKQDLSAPPGYTLTENVARILNKKLLEHALKEERRQAAHGPPGLHSDS 1282
185P2C9v.2      ----------------------HQFPRKVA------------------------------ 1142
185P2C9v.3      EMCREEGGEGTPVKQDLSAPPGYTLTENVARILNKKLLEHALKEERRQAAHGPPGLHSDS 1292
                                            **
```

Figure 14n (continued)

```
185P2C9v.1      HSLGDTAEPGPMENQTVLLTAP---------------------------------------- 1304
185P2C9v.2      --------------------------------------------------------------
185P2C9v.3      HSLGDTAEPGPMEELPCSALAPSLEPCFSRPERPANRRPPSRWAPHSPTASQPQSPGDPT 1352

185P2C9v.1      ---------------------WGL------ 1307
185P2C9v.2      ------------------------------
185P2C9v.3      SLEEHGGEEPPEEQPHRDASLHGLSQYNSL 1382
```

Figure 11o Nucleotide sequences of transcript variants of 185P3C2
>185P3C2 v.2 (SEQ ID NO:161).

```
acaactgtct gctgcgcccg aaaaacaagt cggtgcgctg gggacccggg gccggggccg      60
ccttactccg gcctagcccc gcggccctcg gtgcgggctc cagggcatgc tcggtacccc     120
ccgcggctcc agcccagacg ccccggcctc agaaatcgcc cggaaatggg agcttgcgcg     180
aagcgctgat cggcccgctg gggaagctca tggacccggg ctccctgccg cccctcgact     240
ctgaagatct cttccaggat ctaagtcact tccaggagac gtggctcgct gaagctcagg     300
taccagacag tgatgagcag tttgttcctg atttccattc agaaaaccta gctttccaca     360
gccccaccac caggatcaag aaggagcccc agagtccccg cacagacccg gccctgtcct     420
gcagcaggaa gccgccactc ccctaccacc atggcgagca gtgcctttac tccagtgcct     480
atgacccccc cagacaaatc gccatcaagt cccctgcccc tggtgccctt ggacagtcgc     540
ccctacagcc ctttccccgg gcagagcaac ggaatttcct gagatcctct ggcacctccc     600
agccccaccc tggccatggg tacctcgggg aacatagctc cgtcttccag cagccctgg      660
acatttgcca ctccttcaca tctcagggag gggccgggga accctcccca gccccctacc     720
aacaccagct gtcggagccc tgcccaccct atccccagca gagctttaag caagaatacc     780
atgatcccct gtatgaacag gcggggcagc cagccgtgga ccagggtggg gtcaatgggc     840
acaggtaccc aggggcgggg gtggtgatca aacaggaaca gacggacttc gcctacgact     900
cagatgtcac cgggtgcgca tcaatgtacc tccacacaga gggcttctct gggccctctc     960
caggtgacgg ggccatgggc tatggctatg agaaacctct gcgaccattc ccagatgatg    1020
tctgcgttgt ccctgagaaa tttgaaggag acatcaagca ggaaggggtc ggtgcatttc    1080
gagaggggcc gccctaccag cgccggggtg ccctgcagct gtggcaattt ctggtggcct    1140
tgctggatga cccaacaaat gcccatttca ttgcctggac gggccgggga atggagttca    1200
agctcattga gcctgaggag gtcgccaggc tctggggcat ccagaagaac cggccagcca    1260
tgaattacga caagctgagc cgctcgctcc gatactatta tgagaaaggc atcatgcaga    1320
aggtggctgg tgagcgttac gtgtacaagt ttgtgtgtga gcccgaggcc ctcttctctt    1380
tggccttccc ggacaatcag cgtccagctc tcaaggctga gtttgaccgg cctgtcagtg    1440
aggaggacac agtccctttg tcccacttgg atgagagccc cgcctacctc ccagagctgg    1500
ctggccccgc ccagccattt ggccccaagg gtggctactc ttactagccc ccagcggctg    1560
```

Figure 11o (continued)

```
ttccccctgc cgcaggtggg tgctgccctg tgtacatata aatgaatctg gtgttgggga    1620
aaccttcatc tgaaacccac agatgtctct ggggcagatc cccactgtcc taccagttgc    1680
cctagcccag actctgagct gctcaccgga gtcattggga aggaaaagtg gagaaatggc    1740
aagtctagag tctcagaaac tcccctgggg gtttcacctg ggccctggag gaattcagct    1800
cagcttcttc ctaggtccaa gccccccaca ccttttcccc aacccacagag aacaagagtt    1860
tgttctgttc tgggggacag agaaggcgct tcccaacttc atactggcag gagggtgagg    1920
aggttcactg agctccccag atctcccact gcggggagac agaagcctgg actctgcccc    1980
acgctgtggc cctggagggt cccggtttgt cagttcttgg tgctctgtgt tcccagaggc    2040
aggcggaggt tgaagaaagg aacctgggat gaggggtgct gggtataagc agagagggat    2100
gggttcctgc tccaagggac cctttgcctt tcttctgccc tttcctaggc ccaggcctgg    2160
gtttgtactt ccacctccac cacatctgcc agaccttaat aaaggccccc acttctccca    2220
tt                                                                   2222
```

>185P3C2 v.3 (SEQ ID NO:162).

```
acaactgtct gctgcgcccg aaaaacaagt cggtgcgctg gggacccggg gccggggccg      60
ccttactccg gcctagcccc gcggccctcg gtgcgggctc cagggcatgc tcggtacccc     120
ccgcggctcc agcccagacg ccccggcctc aggtctcggc ccccgcttgg ggccccggcc     180
gtgcggcgcg agggagcggc cggatggagc ggaggatgaa agccggatac ttggaccagc     240
aagtgcccta caccttcagc agcaaatcgc ccggaaatgg gagcttgcgc gaagcgctga     300
tcggcccgct ggggaagctc atggacccgg gctccctgcc gcccctcgac tctgaagatc     360
tcttccagga tctaagtcac ttccaggaga cgtggctcgc tgaagctcag gtaccagaca     420
gtgatgagca gtttgttcct gatttccatt cagaaaacct agctttccac agccccacca     480
ccaggatcaa gaaggagccc cagagtcccc gcacagaccc ggccctgtcc tgcagcagga     540
agccgccact ccccctaccac catggcgagc agtgccttta ctccagtgcc tatgaccccc     600
ccagacaaat cgccatcaag tcccctgccc ctggtgccct tggacagtcg cccctacagc     660
cctttccccg ggcagagcaa cggaatttcc tgagatcctc tggcacctcc cagccccacc     720
ctggccatgg gtacctcggg gaacatagat gtcaccgggt gcgcatcaat gtacctccac     780
acagagggct tctctgggcc ctctccaggt gacggggcca tgggctatgg ctatgagaaa     840
cctctgcgac cattcccaga tgatgtctgc gttgtccctg agaaatttga aggagacatc     900
aagcaggaag gggtcggtgc atttcgagag gggccgccct accagcgccg gggtgccctg     960
cagctgtggc aatttctggt ggccttgctg gatgacccaa caaatgccca tttcattgcc    1020
tggacgggcc ggggaatgga gttcaagctc attgagcctg aggaggtcgc caggctctgg    1080
ggcatccaga agaaccggcc agccatgaat tacgacaagc tgagccgctc gctccgatac    1140
tattatgaga aaggcatcat gcagaaggtg gctggtgagc gttacgtgta caagtttgtg    1200
tgtgagcccg aggccctctt ctctttggcc ttcccggaca atcagcgtcc agctctcaag    1260
gctgagtttg accggcctgt cagtgaggag gacacagtcc ctttgtccca cttggatgag    1320
agccccgcct acctcccaga gctggctggc cccgcccagc catttggccc caagggtggc    1380
tactcttact agcccccagc ggctgttccc cctgccgcag gtgggtgctg ccctgtgtac    1440
atataaatga atctggtgtt ggggaaacct tcatctgaaa cccacagatg tctctggggc    1500
```

Figure 11o (continued)

```
agatccccac tgtcctacca gttgccctag cccagactct gagctgctca ccggagtcat   1560
tgggaaggaa aagtggagaa atggcaagtc tagagtctca gaaactcccc tgggggtttc   1620
acctgggccc tggaggaatt cagctcagct tcttcctagg tccaagcccc ccacaccttt   1680
tccccaacca cagagaacaa gagtttgttc tgttctgggg gacagagaag gcgcttccca   1740
acttcatact ggcaggaggg tgaggaggtt cactgagctc cccagatctc ccactgcggg   1800
gagacagaag cctggactct gccccacgct gtggccctgg agggtcccgg tttgtcagtt   1860
cttggtgctc tgtgttccca gaggcaggcg gaggttgaag aaaggaacct gggatgaggg   1920
gtgctgggta taagcagaga gggatgggtt cctgctccaa gggacccttt gcctttcttc   1980
tgccctttcc taggcccagg cctgggtttg tacttccacc tccaccacat ctgccagacc   2040
ttaataaagg cccccacttc tcccatt                                       2067
```

>185P3C2 v.4 (SEQ ID NO:163).

```
acaactgtct gctgcgcccg aaaaacaagt cggtgcgctg gggacccggg gccggggccg     60
ccttactccg gcctagcccc gcggccctcg gtgcgggctc cagggcatgc tcggtacccc    120
ccgcggctcc agcccagacg ccccggcctc aggtctcggc ccccgcttgg ggccccggcc    180
gtgcggcgcg agggagcggc cggatggagc ggaggatgaa agccggatac ttggaccagc    240
aagtgcccta caccttcagc agcaaatcgc ccggaaatgg gagcttgcgc gaagcgctga    300
tcggcccgct ggggaagctc atggacccgg gctccctgcc gcccctcgac tctgaagatc    360
tcttccagga tctaagtcac ttccaggaga cgtggctcgc tgaagctcag gtaccagaca    420
gtgatgagca gtttgttcct gatttccatt cagaaaacct agctttccac agccccacca    480
ccaggatcaa gaaggagccc cagagtcccc gcacagaccc ggccctgtcc tgcagcagga    540
agccgccact cccctaccac catggcgagc agtgccttta ctccagtgcc tatgaccccc    600
ccagacaaat cgccatcaag tcccctgccc ctggtgccct tggacagtcg cccctacagc    660
cctttccccg ggcagagcaa cggaatttcc tgagatcctc tggcacctcc cagccccacc    720
ctggccatgg gtacctcggg gaacatagct ccgtcttcca gcagcccctg gacatttgcc    780
actccttcac atctcaggga gggggccggg aaccccctccc agccccctac caacaccagc    840
tgtcggagcc ctgcccaccc tatccccagc agagctttaa gcaagaatac catgatcccc    900
tgtatgaaca ggcgggccag ccagccgtgg accagggtgg ggtcaatggg cacaggtacc    960
caggggcggg ggtggtgatc aaacaggaac agacggactt cgcctacgac tcagatgtca   1020
ccgggtgcgc atcaatgtac ctccacacag agggcttctc tgggccctct ccaggctatg   1080
gctatgagaa acctctgcga ccattcccag atgatgtctg cgttgtccct gagaaatttg   1140
aaggagacat caagcaggaa ggggtcggtg catttcgaga ggggccgccc taccagcgcc   1200
ggggtgccct gcagctgtgg caatttctgg tggccttgct ggatgaccca acaaatgccc   1260
atttcattgc ctggacgggc cggggaatgg agttcaagct cattgagcct gaggaggtcg   1320
ccaggctctg ggcatccag aagaaccggc cagccatgaa ttacgacaag ctgagccgct   1380
cgctccgata ctattatgag aaaggcatca tgcagaaggt ggctggtgag cgttacgtgt   1440
acaagtttgt gtgtgagccc gaggccctct tctctttggc cttcccggac aatcagcgtc   1500
cagctctcaa ggctgagttt gaccggcctg tcagtgagga ggacacagtc cctttgtccc   1560
acttggatga gagccccgcc tacctcccag agctggctgg ccccgcccag ccatttggcc   1620
```

Figure 11o (continued)

```
ccaagggtgg ctactcttac tagcccccag cggctgttcc ccctgccgca ggtgggtgct    1680
gccctgtgta catataaatg aatctggtgt tggggaaacc ttcatctgaa acccacagat    1740
gtctctgggg cagatcccca ctgtcctacc agttgcccta gcccagactc tgagctgctc    1800
accggagtca ttgggaagga aaagtggaga aatggcaagt ctagagtctc agaaactccc    1860
ctggggtttt cacctgggcc ctggaggaat tcagctcagc ttcttcctag gtccaagccc    1920
cccacacctt ttccccaacc acagagaaca agagtttgtt ctgttctggg ggacagagaa    1980
ggcgcttccc aacttcatac tggcaggagg gtgaggaggt tcactgagct ccccagatct    2040
cccactgcgg ggagacagaa gcctggactc tgccccacgc tgtggccctg gagggtcccg    2100
gtttgtcagt tcttggtgct ctgtgttccc agaggcaggc ggaggttgaa gaaaggaacc    2160
tgggatgagg ggtgctgggt ataagcagag agggatgggt tcctgctcca agggaccctt    2220
tgcctttctt ctgccctttc ctaggcccag gcctgggttt gtacttccac ctccaccaca    2280
tctgccagac cttaataaag gcccccactt ctcccatt                            2318
```

>185P3C2 v.5 (SEQ ID NO:164).

```
acaactgtct gctgcgcccg aaaaacaagt cggtgcgctg gggacccggg gccgggggccg     60
ccttactccg gcctagcccc gcggccctcg gtgcgggctc cagggcatgc tcggtacccc    120
ccgcggctcc agcccagacg ccccggcctc aggtctcggc ccccgcttgg ggccccggcc    180
gtgcggcgcg agggagcggc cggatggagc ggaggatgaa agccggatac ttggaccagc    240
aagtgcccta caccttcagc agcgtgagcg ccgcgccggc ctccacgccc gccccgcccc    300
gcacccagcc cctactctca ccacagcccc cctccccgca gtcccagcgg agtcctgggc    360
tgccccgccc ctgagtcacc cgaggacccc aacctcgtcc cccagactaa gcgcctcagg    420
gtgactcgcg ggcattctcc ccgcttctcg cagaaatcgc ccggaaatgg gagcttgcgc    480
gaagcgctga tcggcccgct ggggaagctc atggacccgg gctccctgcc gcccctcgac    540
tctgaagatc tcttccagga tctaagtcac ttccaggaga cgtggctcgc tgaagctcag    600
gtaccagaca gtgatgagca gtttgttcct gatttccatt cagaaaacct agctttccac    660
agccccacca ccaggatcaa gaaggagccc cagagtcccc gcacagaccc ggccctgtcc    720
tgcagcagga agccgccact cccctaccac catggcgagc agtgccttta ctccagtgcc    780
tatgaccccc ccagacaaat cgccatcaag tcccctgccc ctggtgccct tggacagtcg    840
cccctacagc cctttccccg ggcagagcaa cggaatttcc tgagatcctc tggcacctcc    900
cagccccacc ctggccatgg gtacctcggg gaacatagct ccgtcttcca gcagcccctg    960
gacatttgcc actccttcac atctcaggga gggggccggg aacccctccc agcccctac    1020
caacaccagc tgtcggagcc ctgcccaccc tatccccagc agagctttaa gcaagaatac   1080
catgatcccc tgtatgaaca ggcgggccag ccagccgtgg accagggtgg ggtcaatggg   1140
cacaggtacc caggggcggg ggtggtgatc aaacaggaac agacggactt cgcctacgac   1200
tcagatgtca ccgggtgcgc atcaatgtac ctccacacag agggcttctc tgggccctct   1260
ccaggtgacg gggccatggg ctatggctat gagaaacctc tgcgaccatt cccagatgat   1320
gtctgcgttg tccctgagaa atttgaagga gacatcaagc aggaaggggt cggtgcattt   1380
cgagaggggc cgccctacca gcgccggggt gccctgcagc tgtggcaatt tctggtggcc   1440
ttgctggatg acccaacaaa tgcccatttc attgcctgga cgggccgggg aatggagttc   1500
```

Figure 11o (continued)

```
aagctcattg agcctgagga ggtcgccagg ctctggggca tccagaagaa ccggccagcc   1560
atgaattacg acaagctgag ccgctcgctc cgatactatt atgagaaagg catcatgcag   1620
aaggtggctg gtgagcgtta cgtgtacaag tttgtgtgtg agcccgaggc cctcttctct   1680
ttggccttcc cggacaatca gcgtccagct ctcaaggctg agtttgaccg gcctgtcagt   1740
gaggaggaca cagtcccttt gtcccacttg gatgagagcc ccgcctacct cccagagctg   1800
gctggccccg cccagccatt tggccccaag ggtggctact cttactagcc cccagcggct   1860
gttccccctg ccgcaggtgg gtgctgccct gtgtacatat aaatgaatct ggtgttgggg   1920
aaaccttcat ctgaaaccca cagatgtctc tggggcagat ccccactgtc ctaccagttg   1980
ccctagccca gactctgagc tgctcaccgg agtcattggg aaggaaaagt ggagaaatgg   2040
caagtctaga gtctcagaaa ctcccctggg ggtttcacct gggccctgga ggaattcagc   2100
tcagcttctt cctaggtcca agccccccac accttttccc caaccacaga gaacaagagt   2160
ttgttctgtt ctggggcaca gagaaggcgc ttcccaactt catactggca ggagggtgag   2220
gaggttcact gagctcccca gatctcccac tgcggggaga cagaagcctg gactctgccc   2280
cacgctgtgg ccctggaggg tcccggtttg tcagttcttg gtgctctgtg ttcccagagg   2340
caggcggagg ttgaagaaag gaacctggga tgaggggtgc tgggtataag cagagaggga   2400
tgggttcctg ctccaaggga ccctttgcct ttcttctgcc ctttcctagg cccaggcctg   2460
ggtttgtact tccacctcca ccacatctgc cagaccttaa taaaggcccc cacttctccc   2520
att                                                                 2523
```

Figure 12o Protein sequences of transcript variants of 185P3C2

>185P3C2 v.2 (SEQ ID NO:165).

```
NCLLRPKNKS VRWGPGAGAA LLRPSPAALG AGSRACSVPP AAPAQTPRPQ KSPGNGSLRE     60
ALIGPLGKLM DPGSLPPLDS EDLFQDLSHF QETWLAEAQV PDSDEQFVPD FHSENLAFHS    120
PTTRIKKEPQ SPRTDPALSC SRKPPLPYHH GEQCLYSSAY DPPRQIAIKS PAPGALGQSP    180
LQPFPRAEQR NFLRSSGTSQ PHPGHGYLGE HSSVFQQPLD ICHSFTSQGG GREPLPAPYQ    240
HQLSEPCPPY PQQSFKQEYH DPLYEQAGQP AVDQGGVNGH RYPGAGVVIK QEQTDFAYDS    300
DVTGCASMYL HTEGFSGPSP GDGAMGYGYE KPLRPFPDDV CVVPEKFEGD IKQEGVGAFR    360
EGPPYQRRGA LQLWQFLVAL LDDPTNAHFI AWTGRGMEFK LIEPEEVARL WGIQKNRPAM    420
NYDKLSRSLR YYYEKGIMQK VAGERYVYKF VCEPEALFSL AFPDNQRPAL KAEFDRPVSE    480
EDTVPLSHLD ESPAYLPELA GPAQPFGPKG GYSY                                514
```

>185P3C2 v.3A (SEQ ID NO:166).

```
NCLLRPKNKS VRWGPGAGAA LLRPSPAALG AGSRACSVPP AAPAQTPRPQ VSAPAWGPGR     60
AARGSGRMER RMKAGYLDQQ VPYTFSSKSP GNGSLREALI GPLGKLMDPG SLPPLDSEDL    120
FQDLSHFQET WLAEAQVPDS DEQFVPDFHS ENLAFHSPTT RIKKEPQSPR TDPALSCSRK    180
PPLPYHHGEQ CLYSSAYDPP RQIAIKSPAP GALGQSPLQP FPRAEQRNFL RSSGTSQPHP    240
GHGYLGEHRC HRVRINVPPH RGLLWALSR                                      269
```

Figure 12o (continued)

```
>185P3C2 v.3B (SEQ ID NO 167).
MGTSGNIDVT GCASMYLHTE GFSGPSPGDG AMGYGYEKPL RPFPDDVCVV PEKFEGDIKQ      60
EGVGAFREGP PYQRRGALQL WQFLVALLDD PTNAHFIAWT GRGMEFKLIE PEEVARLWGI     120
QKNRPAMNYD KLSRSLRYYY EKGIMQKVAG ERYVYKFVCE PEALFSLAFP DNQRPALKAE     180
FDRPVSEEDT VPLSHLDESP AYLPELAGPA QPFGPKGGYS Y                         221

>185P3C2 v.4 (SEQ ID NO 168).
NCLLRPKNKS VRWGPGAGAA LLRPSPAALG AGSRACSVPP AAPAQTPRPQ VSAPAWGPGR      60
AARGSGRMER RMKAGYLDQQ VPYTFSSKSP GNGSLREALI GPLGKLMDPG SLPPLDSEDL     120
FQDLSHFQET WLAEAQVPDS DEQFVPDFHS ENLAFHSPTT RIKKEPQSPR TDPALSCSRK     180
PPLPYHHGEQ CLYSSAYDPP RQIAIKSPAP GALGQSPLQP FPRAEQRNFL RSSGTSQPHP     240
GHGYLGEHSS VFQQPLDICH SFTSQGGGRE PLPAPYQHQL SEPCPPYPQQ SFKQEYHDPL     300
YEQAGQPAVD QGGVNGHRYP GAGVVIKQEQ TDFAYDSDVT GCASMYLHTE GFSGPSPGYG     360
YEKPLRPFPD DVCVVPEKFE GDIKQEGVGA FREGPPYQRR GALQLWQFLV ALLDDPTNAH     420
FIAWTGRGME FKLIEPEEVA RLWGIQKNRP AMNYDKLSRS LRYYYEKGIM QKVAGERYVY     480
KFVCEPEALF SLAFPDNQRP ALKAEFDRPV SEEDTVPLSH LDESPAYLPE LAGPAQPFGP     540
KGGYSY                                                                546

>185P3C2 v.5 (SEQ ID NO 169).
MDPGSLPPLD SEDLFQDLSH FQETWLAEAQ VPDSDEQFVP DFHSENLAFH SPTTRIKKEP      60
QSPRTDPALS CSRKPPLPYH HGEQCLYSSA YDPPRQIAIK SPAPGALGQS PLQPFPRAEQ     120
RNFLRSSGTS QPHPGHGYLG EHSSVFQQPL DICHSFTSQG GGREPLPAPY QHQLSEPCPP     180
YPQQSFKQEY HDPLYEQAGQ PAVDQGGVNG HRYPGAGVVI KQEQTDFAYD SDVTGCASMY     240
LHTEGFSGPS PGDGAMGYGY EKPLRPFPDD VCVVPEKFEG DIKQEGVGAF REGPPYQRRG     300
ALQLWQFLVA LLDDPTNAHF IAWTGRGMEF KLIEPEEVAR LWGIQKNRPA MNYDKLSRSL     360
RYYYEKGIMQ KVAGERYVYK FVCEPEALFS LAFPDNQRPA LKAEFDRPVS EEDTVPLSHL     420
DESPAYLPEL AGPAQPFGPK GGYSY                                           445
```

Figure 13o Alignment of nucleotide sequences of 185P3C2 transcript variants (SEQ ID NOS:53, 161, 162, 163, 164).

```
185P3C2v.1      ACAACTGTCTGCTGCGCCCGAAAAACAAGTCGGTGCGCTGGGGACCCGGGGCCGGGGCCG 60
185P3C2v.2      ACAACTGTCTGCTGCGCCCGAAAAACAAGTCGGTGCGCTGGGGACCCGGGGCCGGGGCCG 60
185P3C2v.3      ACAACTGTCTGCTGCGCCCGAAAAACAAGTCGGTGCGCTGGGGACCCGGGGCCGGGGCCG 60
185P3C2v.4      ACAACTGTCTGCTGCGCCCGAAAAACAAGTCGGTGCGCTGGGGACCCGGGGCCGGGGCCG 60
185P3C2v.5      ACAACTGTCTGCTGCGCCCGAAAAACAAGTCGGTGCGCTGGGGACCCGGGGCCGGGGCCG 60
                ************************************************************
```

Figure 13o (continued)

```
185P3C2v.1      CCTTACTCCGGCCTAGCCCCGCGGCCCTCGGTGCGGGCTCCAGGGCATGCTCGGTACCCC 120
185P3C2v.2      CCTTACTCCGGCCTAGCCCCGCGGCCCTCGGTGCGGGCTCCAGGGCATGCTCGGTACCCC 120
185P3C2v.3      CCTTACTCCGGCCTAGCCCCGCGGCCCTCGGTGCGGGCTCCAGGGCATGCTCGGTACCCC 120
185P3C2v.4      CCTTACTCCGGCCTAGCCCCGCGGCCCTCGGTGCGGGCTCCAGGGCATGCTCGGTACCCC 120
185P3C2v.5      CCTTACTCCGGCCTAGCCCCGCGGCCCTCGGTGCGGGCTCCAGGGCATGCTCGGTACCCC 120
                ************************************************************

185P3C2v.1      CCGCGGCTCCAGCCCAGACGCCCCGGCCTCAGGTCTCGGCCCCCGCTTGGGGCCCCGGCC 180
185P3C2v.2      CCGCGGCTCCAGCCCAGACGCCCCGGCCTCAG---------------------------- 152
185P3C2v.3      CCGCGGCTCCAGCCCAGACGCCCCGGCCTCAGGTCTCGGCCCCCGCTTGGGGCCCCGGCC 180
185P3C2v.4      CCGCGGCTCCAGCCCAGACGCCCCGGCCTCAGGTCTCGGCCCCCGCTTGGGGCCCCGGCC 180
185P3C2v.5      CCGCGGCTCCAGCCCAGACGCCCCGGCCTCAGGTCTCGGCCCCCGCTTGGGGCCCCGGCC 180
                ********************************

185P3C2v.1      GTGCGGCGCGAGGGAGCGGCCGGATGGAGCGGAGGATGAAAGCCGGATACTTGGACCAGC 240
185P3C2v.2      ------------------------------------------------------------
185P3C2v.3      GTGCGGCGCGAGGGAGCGGCCGGATGGAGCGGAGGATGAAAGCCGGATACTTGGACCAGC 240
185P3C2v.4      GTGCGGCGCGAGGGAGCGGCCGGATGGAGCGGAGGATGAAAGCCGGATACTTGGACCAGC 240
185P3C2v.5      GTGCGGCGCGAGGGAGCGGCCGGATGGAGCGGAGGATGAAAGCCGGATACTTGGACCAGC 240

185P3C2v.1      AAGTGCCCTACACCTTCAGCAGC------------------------------------- 263
185P3C2v.2      ------------------------------------------------------------
185P3C2v.3      AAGTGCCCTACACCTTCAGCAGC------------------------------------- 263
185P3C2v.4      AAGTGCCCTACACCTTCAGCAGC------------------------------------- 263
185P3C2v.5      AAGTGCCCTACACCTTCAGCAGCGTGAGCGCCGCGCCGGCCTCCACGCCCGCCCCGCCCC 300

185P3C2v.1      ------------------------------------------------------------
185P3C2v.2      ------------------------------------------------------------
185P3C2v.3      ------------------------------------------------------------
185P3C2v.4      ------------------------------------------------------------
185P3C2v.5      GCACCCAGCCCCTACTCTCACCACAGCCCCCCTCCCCGCAGTCCCAGCGGAGTCCTGGGC 360

185P3C2v.1      ------------------------------------------------------------
185P3C2v.2      ------------------------------------------------------------
185P3C2v.3      ------------------------------------------------------------
185P3C2v.4      ------------------------------------------------------------
```

```
185P3C2v.5      TGCCCCGCCCCTGAGTCACCCGAGGACCCCAACCTCGTCCCCCAGACTAAGCGCCTCAGG 420

185P3C2v.1      ---------------------------------AAATCGCCCGGAAATGGGAGCTTGCGC 290
185P3C2v.2      ---------------------------------AAATCGCCCGGAAATGGGAGCTTGCGC 179
185P3C2v.3      ---------------------------------AAATCGCCCGGAAATGGGAGCTTGCGC 290
185P3C2v.4      ---------------------------------AAATCGCCCGGAAATGGGAGCTTGCGC 290
185P3C2v.5      GTGACTCGCGGGCATTCTCCCCGCTTCTCGCAGAAATCGCCCGGAAATGGGAGCTTGCGC 480
                                                 ***************************

185P3C2v.1      GAAGCGCTGATCGGCCCGCTGGGGAAGCTCATGGACCCGGGCTCCCTGCCGCCCCTCGAC 350
185P3C2v.2      GAAGCGCTGATCGGCCCGCTGGGGAAGCTCATGGACCCGGGCTCCCTGCCGCCCCTCGAC 239
185P3C2v.3      GAAGCGCTGATCGGCCCGCTGGGGAAGCTCATGGACCCGGGCTCCCTGCCGCCCCTCGAC 350
185P3C2v.4      GAAGCGCTGATCGGCCCGCTGGGGAAGCTCATGGACCCGGGCTCCCTGCCGCCCCTCGAC 350
185P3C2v.5      GAAGCGCTGATCGGCCCGCTGGGGAAGCTCATGGACCCGGGCTCCCTGCCGCCCCTCGAC 540
                ************************************************************

185P3C2v.1      TCTGAAGATCTCTTCCAGGATCTAAGTCACTTCCAGGAGACGTGGCTCGCTGAAGCTCAG 410
185P3C2v.2      TCTGAAGATCTCTTCCAGGATCTAAGTCACTTCCAGGAGACGTGGCTCGCTGAAGCTCAG 299
185P3C2v.3      TCTGAAGATCTCTTCCAGGATCTAAGTCACTTCCAGGAGACGTGGCTCGCTGAAGCTCAG 410
185P3C2v.4      TCTGAAGATCTCTTCCAGGATCTAAGTCACTTCCAGGAGACGTGGCTCGCTGAAGCTCAG 410
185P3C2v.5      TCTGAAGATCTCTTCCAGGATCTAAGTCACTTCCAGGAGACGTGGCTCGCTGAAGCTCAG 600
                ************************************************************

185P3C2v.1      GTACCAGACAGTGATGAGCAGTTTGTTCCTGATTTCCATTCAGAAAACCTAGCTTTCCAC 470
185P3C2v.2      GTACCAGACAGTGATGAGCAGTTTGTTCCTGATTTCCATTCAGAAAACCTAGCTTTCCAC 359
185P3C2v.3      GTACCAGACAGTGATGAGCAGTTTGTTCCTGATTTCCATTCAGAAAACCTAGCTTTCCAC 470
185P3C2v.4      GTACCAGACAGTGATGAGCAGTTTGTTCCTGATTTCCATTCAGAAAACCTAGCTTTCCAC 470
185P3C2v.5      GTACCAGACAGTGATGAGCAGTTTGTTCCTGATTTCCATTCAGAAAACCTAGCTTTCCAC 660
                ************************************************************

185P3C2v.1      AGCCCCACCACCAGGATCAAGAAGGAGCCCCAGAGTCCCCGCACAGACCCGGCCCTGTCC 530
185P3C2v.2      AGCCCCACCACCAGGATCAAGAAGGAGCCCCAGAGTCCCCGCACAGACCCGGCCCTGTCC 419
185P3C2v.3      AGCCCCACCACCAGGATCAAGAAGGAGCCCCAGAGTCCCCGCACAGACCCGGCCCTGTCC 530
185P3C2v.4      AGCCCCACCACCAGGATCAAGAAGGAGCCCCAGAGTCCCCGCACAGACCCGGCCCTGTCC 530
185P3C2v.5      AGCCCCACCACCAGGATCAAGAAGGAGCCCCAGAGTCCCCGCACAGACCCGGCCCTGTCC 720
                ************************************************************

185P3C2v.1      TGCAGCAGGAAGCCGCCACTCCCCTACCACCATGGCGAGCAGTGCCTTTACTCCAGTGCC 590
```

Figure 13o (continued)

```
185P3C2v.2      TGCAGCAGGAAGCCGCCACTCCCCTACCACCATGGCGAGCAGTGCCTTTACTCCAGTGCC 479
185P3C2v.3      TGCAGCAGGAAGCCGCCACTCCCCTACCACCATGGCGAGCAGTGCCTTTACTCCAGTGCC 590
185P3C2v.4      TGCAGCAGGAAGCCGCCACTCCCCTACCACCATGGCGAGCAGTGCCTTTACTCCAGTGCC 590
185P3C2v.5      TGCAGCAGGAAGCCGCCACTCCCCTACCACCATGGCGAGCAGTGCCTTTACTCCAGTGCC 780
                ************************************************************

185P3C2v.1      TATGACCCCCCCAGACAAATCGCCATCAAGTCCCCTGCCCCTGGTGCCCTTGGACAGTCG 650
185P3C2v.2      TATGACCCCCCCAGACAAATCGCCATCAAGTCCCCTGCCCCTGGTGCCCTTGGACAGTCG 539
185P3C2v.3      TATGACCCCCCCAGACAAATCGCCATCAAGTCCCCTGCCCCTGGTGCCCTTGGACAGTCG 650
185P3C2v.4      TATGACCCCCCCAGACAAATCGCCATCAAGTCCCCTGCCCCTGGTGCCCTTGGACAGTCG 650
185P3C2v.5      TATGACCCCCCCAGACAAATCGCCATCAAGTCCCCTGCCCCTGGTGCCCTTGGACAGTCG 840
                ************************************************************

185P3C2v.1      CCCCTACAGCCCTTTCCCCGGGCAGAGCAACGGAATTTCCTGAGATCCTCTGGCACCTCC 710
185P3C2v.2      CCCCTACAGCCCTTTCCCCGGGCAGAGCAACGGAATTTCCTGAGATCCTCTGGCACCTCC 599
185P3C2v.3      CCCCTACAGCCCTTTCCCCGGGCAGAGCAACGGAATTTCCTGAGATCCTCTGGCACCTCC 710
185P3C2v.4      CCCCTACAGCCCTTTCCCCGGGCAGAGCAACGGAATTTCCTGAGATCCTCTGGCACCTCC 710
185P3C2v.5      CCCCTACAGCCCTTTCCCCGGGCAGAGCAACGGAATTTCCTGAGATCCTCTGGCACCTCC 900
                ************************************************************

185P3C2v.1      CAGCCCCACCCTGGCCATGGGTACCTCGGGGAACATAGCTCCGTCTTCCAGCAGCCCCTG 770
185P3C2v.2      CAGCCCCACCCTGGCCATGGGTACCTCGGGGAACATAGCTCCGTCTTCCAGCAGCCCCTG 659
185P3C2v.3      CAGCCCCACCCTGGCCATGGGTACCTCGGGGAACATAG---------------------- 748
185P3C2v.4      CAGCCCCACCCTGGCCATGGGTACCTCGGGGAACATAGCTCCGTCTTCCAGCAGCCCCTG 770
185P3C2v.5      CAGCCCCACCCTGGCCATGGGTACCTCGGGGAACATAGCTCCGTCTTCCAGCAGCCCCTG 960
                **************************************

185P3C2v.1      GACATTTGCCACTCCTTCACATCTCAGGGAGGGGGCCGGGAACCCCTCCCAGCCCCCTAC 830
185P3C2v.2      GACATTTGCCACTCCTTCACATCTCAGGGAGGGGGCCGGGAACCCCTCCCAGCCCCCTAC 719
185P3C2v.3      ------------------------------------------------------------
185P3C2v.4      GACATTTGCCACTCCTTCACATCTCAGGGAGGGGGCCGGGAACCCCTCCCAGCCCCCTAC 830
185P3C2v.5      GACATTTGCCACTCCTTCACATCTCAGGGAGGGGGCCGGGAACCCCTCCCAGCCCCCTAC 1020

185P3C2v.1      CAACACCAGCTGTCGGAGCCCTGCCCACCCTATCCCCAGCAGAGCTTTAAGCAAGAATAC 890
185P3C2v.2      CAACACCAGCTGTCGGAGCCCTGCCCACCCTATCCCCAGCAGAGCTTTAAGCAAGAATAC 779
185P3C2v.3      ------------------------------------------------------------
185P3C2v.4      CAACACCAGCTGTCGGAGCCCTGCCCACCCTATCCCCAGCAGAGCTTTAAGCAAGAATAC 890
185P3C2v.5      CAACACCAGCTGTCGGAGCCCTGCCCACCCTATCCCCAGCAGAGCTTTAAGCAAGAATAC 1080
```

Figure 13o (continued)

```
185P3C2v.1      CATGATCCCCTGTATGAACAGGCGGGCCAGCCAGCCGTGGACCAGGGTGGGGTCAATGGG 950
185P3C2v.2      CATGATCCCCTGTATGAACAGGCGGGCCAGCCAGCCGTGGACCAGGGTGGGGTCAATGGG 839
185P3C2v.3      ------------------------------------------------------------
185P3C2v.4      CATGATCCCCTGTATGAACAGGCGGGCCAGCCAGCCGTGGACCAGGGTGGGGTCAATGGG 950
185P3C2v.5      CATGATCCCCTGTATGAACAGGCGGGCCAGCCAGCCGTGGACCAGGGTGGGGTCAATGGG 1140

185P3C2v.1      CACAGGTACCCAGGGGCGGGGGTGGTGATCAAACAGGAACAGACGGACTTCGCCTACGAC 1010
185P3C2v.2      CACAGGTACCCAGGGGCGGGGGTGGTGATCAAACAGGAACAGACGGACTTCGCCTACGAC 899
185P3C2v.3      ------------------------------------------------------------
185P3C2v.4      CACAGGTACCCAGGGGCGGGGGTGGTGATCAAACAGGAACAGACGGACTTCGCCTACGAC 1010
185P3C2v.5      CACAGGTACCCAGGGGCGGGGGTGGTGATCAAACAGGAACAGACGGACTTCGCCTACGAC 1200

185P3C2v.1      TCAGATGTCACCGGGTGCGCATCAATGTACCTCCACACAGAGGGCTTCTCTGGGCCCTCT 1070
185P3C2v.2      TCAGATGTCACCGGGTGCGCATCAATGTACCTCCACACAGAGGGCTTCTCTGGGCCCTCT 959
185P3C2v.3      ----ATGTCACCGGGTGCGCATCAATGTACCTCCACACAGAGGGCTTCTCTGGGCCCTCT 804
185P3C2v.4      TCAGATGTCACCGGGTGCGCATCAATGTACCTCCACACAGAGGGCTTCTCTGGGCCCTCT 1070
185P3C2v.5      TCAGATGTCACCGGGTGCGCATCAATGTACCTCCACACAGAGGGCTTCTCTGGGCCCTCT 1260
                    ********************************************************

185P3C2v.1      CCAGGTGACGGGGCCATGGGCTATGGCTATGAGAAACCTCTGCGACCATTCCCAGATGAT 1130
185P3C2v.2      CCAGGTGACGGGGCCATGGGCTATGGCTATGAGAAACCTCTGCGACCATTCCCAGATGAT 1019
185P3C2v.3      CCAGGTGACGGGGCCATGGGCTATGGCTATGAGAAACCTCTGCGACCATTCCCAGATGAT 864
185P3C2v.4      CCAGG---------------CTATGGCTATGAGAAACCTCTGCGACCATTCCCAGATGAT 1115
185P3C2v.5      CCAGGTGACGGGGCCATGGGCTATGGCTATGAGAAACCTCTGCGACCATTCCCAGATGAT 1320
                *****               ****************************************

185P3C2v.1      GTCTGCGTTGTCCCTGAGAAATTTGAAGGAGACATCAAGCAGGAAGGGGTCGGTGCATTT 1190
185P3C2v.2      GTCTGCGTTGTCCCTGAGAAATTTGAAGGAGACATCAAGCAGGAAGGGGTCGGTGCATTT 1079
185P3C2v.3      GTCTGCGTTGTCCCTGAGAAATTTGAAGGAGACATCAAGCAGGAAGGGGTCGGTGCATTT 924
185P3C2v.4      GTCTGCGTTGTCCCTGAGAAATTTGAAGGAGACATCAAGCAGGAAGGGGTCGGTGCATTT 1175
185P3C2v.5      GTCTGCGTTGTCCCTGAGAAATTTGAAGGAGACATCAAGCAGGAAGGGGTCGGTGCATTT 1380
                ************************************************************

185P3C2v.1      CGAGAGGGGCCGCCCTACCAGCGCCGGGGTGCCCTGCAGCTGTGGCAATTTCTGGTGGCC 1250
185P3C2v.2      CGAGAGGGGCCGCCCTACCAGCGCCGGGGTGCCCTGCAGCTGTGGCAATTTCTGGTGGCC 1139
```

Figure 13o (continued)

```
185P3C2v.3      CGAGAGGGGCCGCCCTACCAGCGCCGGGGTGCCCTGCAGCTGTGGCAATTTCTGGTGGCC 984
185P3C2v.4      CGAGAGGGGCCGCCCTACCAGCGCCGGGGTGCCCTGCAGCTGTGGCAATTTCTGGTGGCC 1235
185P3C2v.5      CGAGAGGGGCCGCCCTACCAGCGCCGGGGTGCCCTGCAGCTGTGGCAATTTCTGGTGGCC 1440
                ************************************************************

185P3C2v.1      TTGCTGGATGACCCAACAAATGCCCATTTCATTGCCTGGACGGGCCGGGGAATGGAGTTC 1310
185P3C2v.2      TTGCTGGATGACCCAACAAATGCCCATTTCATTGCCTGGACGGGCCGGGGAATGGAGTTC 1199
185P3C2v.3      TTGCTGGATGACCCAACAAATGCCCATTTCATTGCCTGGACGGGCCGGGGAATGGAGTTC 1044
185P3C2v.4      TTGCTGGATGACCCAACAAATGCCCATTTCATTGCCTGGACGGGCCGGGGAATGGAGTTC 1295
185P3C2v.5      TTGCTGGATGACCCAACAAATGCCCATTTCATTGCCTGGACGGGCCGGGGAATGGAGTTC 1500
                ************************************************************

185P3C2v.1      AAGCTCATTGAGCCTGAGGAGGTCGCCAGGCTCTGGGGCATCCAGAAGAACCGGCCAGCC 1370
185P3C2v.2      AAGCTCATTGAGCCTGAGGAGGTCGCCAGGCTCTGGGGCATCCAGAAGAACCGGCCAGCC 1259
185P3C2v.3      AAGCTCATTGAGCCTGAGGAGGTCGCCAGGCTCTGGGGCATCCAGAAGAACCGGCCAGCC 1104
185P3C2v.4      AAGCTCATTGAGCCTGAGGAGGTCGCCAGGCTCTGGGGCATCCAGAAGAACCGGCCAGCC 1355
185P3C2v.5      AAGCTCATTGAGCCTGAGGAGGTCGCCAGGCTCTGGGGCATCCAGAAGAACCGGCCAGCC 1560
                ************************************************************

185P3C2v.1      ATGAATTACGACAAGCTGAGCCGCTCGCTCCGATACTATTATGAGAAAGGCATCATGCAG 1430
185P3C2v.2      ATGAATTACGACAAGCTGAGCCGCTCGCTCCGATACTATTATGAGAAAGGCATCATGCAG 1319
185P3C2v.3      ATGAATTACGACAAGCTGAGCCGCTCGCTCCGATACTATTATGAGAAAGGCATCATGCAG 1164
185P3C2v.4      ATGAATTACGACAAGCTGAGCCGCTCGCTCCGATACTATTATGAGAAAGGCATCATGCAG 1415
185P3C2v.5      ATGAATTACGACAAGCTGAGCCGCTCGCTCCGATACTATTATGAGAAAGGCATCATGCAG 1620
                ************************************************************

185P3C2v.1      AAGGTGGCTGGTGAGCGTTACGTGTACAAGTTTGTGTGTGAGCCCGAGGCCCTCTTCTCT 1490
185P3C2v.2      AAGGTGGCTGGTGAGCGTTACGTGTACAAGTTTGTGTGTGAGCCCGAGGCCCTCTTCTCT 1379
185P3C2v.3      AAGGTGGCTGGTGAGCGTTACGTGTACAAGTTTGTGTGTGAGCCCGAGGCCCTCTTCTCT 1224
185P3C2v.4      AAGGTGGCTGGTGAGCGTTACGTGTACAAGTTTGTGTGTGAGCCCGAGGCCCTCTTCTCT 1475
185P3C2v.5      AAGGTGGCTGGTGAGCGTTACGTGTACAAGTTTGTGTGTGAGCCCGAGGCCCTCTTCTCT 1680
                ************************************************************

185P3C2v.1      TTGGCCTTCCCGGACAATCAGCGTCCAGCTCTCAAGGCTGAGTTTGACCGGCCTGTCAGT 1550
185P3C2v.2      TTGGCCTTCCCGGACAATCAGCGTCCAGCTCTCAAGGCTGAGTTTGACCGGCCTGTCAGT 1439
185P3C2v.3      TTGGCCTTCCCGGACAATCAGCGTCCAGCTCTCAAGGCTGAGTTTGACCGGCCTGTCAGT 1284
185P3C2v.4      TTGGCCTTCCCGGACAATCAGCGTCCAGCTCTCAAGGCTGAGTTTGACCGGCCTGTCAGT 1535
185P3C2v.5      TTGGCCTTCCCGGACAATCAGCGTCCAGCTCTCAAGGCTGAGTTTGACCGGCCTGTCAGT 1740
                ************************************************************
```

Figure 13o (continued)

```
185P3C2v.1      GAGGAGGACACAGTCCCTTTGTCCCACTTGGATGAGAGCCCCGCCTACCTCCCAGAGCTG 1610
185P3C2v.2      GAGGAGGACACAGTCCCTTTGTCCCACTTGGATGAGAGCCCCGCCTACCTCCCAGAGCTG 1499
185P3C2v.3      GAGGAGGACACAGTCCCTTTGTCCCACTTGGATGAGAGCCCCGCCTACCTCCCAGAGCTG 1344
185P3C2v.4      GAGGAGGACACAGTCCCTTTGTCCCACTTGGATGAGAGCCCCGCCTACCTCCCAGAGCTG 1595
185P3C2v.5      GAGGAGGACACAGTCCCTTTGTCCCACTTGGATGAGAGCCCCGCCTACCTCCCAGAGCTG 1800
                ************************************************************

185P3C2v.1      GCTGGCCCCGCCCAGCCATTTGGCCCCAAGGGTGGCTACTCTTACTAGCCCCCAGCGGCT 1670
185P3C2v.2      GCTGGCCCCGCCCAGCCATTTGGCCCCAAGGGTGGCTACTCTTACTAGCCCCCAGCGGCT 1559
185P3C2v.3      GCTGGCCCCGCCCAGCCATTTGGCCCCAAGGGTGGCTACTCTTACTAGCCCCCAGCGGCT 1404
185P3C2v.4      GCTGGCCCCGCCCAGCCATTTGGCCCCAAGGGTGGCTACTCTTACTAGCCCCCAGCGGCT 1655
185P3C2v.5      GCTGGCCCCGCCCAGCCATTTGGCCCCAAGGGTGGCTACTCTTACTAGCCCCCAGCGGCT 1860
                ************************************************************

185P3C2v.1      GTTCCCCCTGCCGCAGGTGGGTGCTGCCCTGTGTACATATAAATGAATCTGGTGTTGGGG 1730
185P3C2v.2      GTTCCCCCTGCCGCAGGTGGGTGCTGCCCTGTGTACATATAAATGAATCTGGTGTTGGGG 1619
185P3C2v.3      GTTCCCCCTGCCGCAGGTGGGTGCTGCCCTGTGTACATATAAATGAATCTGGTGTTGGGG 1464
185P3C2v.4      GTTCCCCCTGCCGCAGGTGGGTGCTGCCCTGTGTACATATAAATGAATCTGGTGTTGGGG 1715
185P3C2v.5      GTTCCCCCTGCCGCAGGTGGGTGCTGCCCTGTGTACATATAAATGAATCTGGTGTTGGGG 1920
                ************************************************************

185P3C2v.1      AAACCTTCATCTGAAACCCACAGATGTCTCTGGGGCAGATCCCCACTGTCCTACCAGTTG 1790
185P3C2v.2      AAACCTTCATCTGAAACCCACAGATGTCTCTGGGGCAGATCCCCACTGTCCTACCAGTTG 1679
185P3C2v.3      AAACCTTCATCTGAAACCCACAGATGTCTCTGGGGCAGATCCCCACTGTCCTACCAGTTG 1524
185P3C2v.4      AAACCTTCATCTGAAACCCACAGATGTCTCTGGGGCAGATCCCCACTGTCCTACCAGTTG 1775
185P3C2v.5      AAACCTTCATCTGAAACCCACAGATGTCTCTGGGGCAGATCCCCACTGTCCTACCAGTTG 1980
                ************************************************************

185P3C2v.1      CCCTAGCCCAGACTCTGAGCTGCTCACCGGAGTCATTGGGAAGGAAAAGTGGAGAAATGG 1850
185P3C2v.2      CCCTAGCCCAGACTCTGAGCTGCTCACCGGAGTCATTGGGAAGGAAAAGTGGAGAAATGG 1739
185P3C2v.3      CCCTAGCCCAGACTCTGAGCTGCTCACCGGAGTCATTGGGAAGGAAAAGTGGAGAAATGG 1584
185P3C2v.4      CCCTAGCCCAGACTCTGAGCTGCTCACCGGAGTCATTGGGAAGGAAAAGTGGAGAAATGG 1835
185P3C2v.5      CCCTAGCCCAGACTCTGAGCTGCTCACCGGAGTCATTGGGAAGGAAAAGTGGAGAAATGG 2040
                ************************************************************

185P3C2v.1      CAAGTCTAGAGTCTCAGAAACTCCCCTGGGGGTTTCACCTGGGCCCTGGAGGAATTCAGC 1910
185P3C2v.2      CAAGTCTAGAGTCTCAGAAACTCCCCTGGGGGTTTCACCTGGGCCCTGGAGGAATTCAGC 1799
185P3C2v.3      CAAGTCTAGAGTCTCAGAAACTCCCCTGGGGGTTTCACCTGGGCCCTGGAGGAATTCAGC 1644
185P3C2v.4      CAAGTCTAGAGTCTCAGAAACTCCCCTGGGGGTTTCACCTGGGCCCTGGAGGAATTCAGC 1895
```

Figure 13o (continued)

```
185P3C2v.5      CAAGTCTAGAGTCTCAGAAACTCCCCTGGGGGTTTCACCTGGCCCTGGAGGAATTCAGC 2100
                ************************************************************

185P3C2v.1      TCAGCTTCTTCCTAGGTCCAAGCCCCCCACACCTTTTCCCCAACCACAGAGAACAAGAGT 1970
185P3C2v.2      TCAGCTTCTTCCTAGGTCCAAGCCCCCCACACCTTTTCCCCAACCACAGAGAACAAGAGT 1859
185P3C2v.3      TCAGCTTCTTCCTAGGTCCAAGCCCCCCACACCTTTTCCCCAACCACAGAGAACAAGAGT 1704
185P3C2v.4      TCAGCTTCTTCCTAGGTCCAAGCCCCCCACACCTTTTCCCCAACCACAGAGAACAAGAGT 1955
185P3C2v.5      TCAGCTTCTTCCTAGGTCCAAGCCCCCCACACCTTTTCCCCAACCACAGAGAACAAGAGT 2160
                ************************************************************

185P3C2v.1      TTGTTCTGTTCTGGGGGACAGAGAAGGCGCTTCCCAACTTCATACTGGCAGGAGGGTGAG 2030
185P3C2v.2      TTGTTCTGTTCTGGGGGACAGAGAAGGCGCTTCCCAACTTCATACTGGCAGGAGGGTGAG 1919
185P3C2v.3      TTGTTCTGTTCTGGGGGACAGAGAAGGCGCTTCCCAACTTCATACTGGCAGGAGGGTGAG 1764
185P3C2v.4      TTGTTCTGTTCTGGGGGACAGAGAAGGCGCTTCCCAACTTCATACTGGCAGGAGGGTGAG 2015
185P3C2v.5      TTGTTCTGTTCTGGGGGACAGAGAAGGCGCTTCCCAACTTCATACTGGCAGGAGGGTGAG 2220
                ************************************************************

185P3C2v.1      GAGGTTCACTGAGCTCCCCAGATCTCCCACTGCGGGGAGACAGAAGCCTGGACTCTGCCC 2090
185P3C2v.2      GAGGTTCACTGAGCTCCCCAGATCTCCCACTGCGGGGAGACAGAAGCCTGGACTCTGCCC 1979
185P3C2v.3      GAGGTTCACTGAGCTCCCCAGATCTCCCACTGCGGGGAGACAGAAGCCTGGACTCTGCCC 1824
185P3C2v.4      GAGGTTCACTGAGCTCCCCAGATCTCCCACTGCGGGGAGACAGAAGCCTGGACTCTGCCC 2075
185P3C2v.5      GAGGTTCACTGAGCTCCCCAGATCTCCCACTGCGGGGAGACAGAAGCCTGGACTCTGCCC 2280
                ************************************************************

185P3C2v.1      CACGCTGTGGCCCTGGAGGGTCCCGGTTTGTCAGTTCTTGGTGCTCTGTGTTCCCAGAGG 2150
185P3C2v.2      CACGCTGTGGCCCTGGAGGGTCCCGGTTTGTCAGTTCTTGGTGCTCTGTGTTCCCAGAGG 2039
185P3C2v.3      CACGCTGTGGCCCTGGAGGGTCCCGGTTTGTCAGTTCTTGGTGCTCTGTGTTCCCAGAGG 1884
185P3C2v.4      CACGCTGTGGCCCTGGAGGGTCCCGGTTTGTCAGTTCTTGGTGCTCTGTGTTCCCAGAGG 2135
185P3C2v.5      CACGCTGTGGCCCTGGAGGGTCCCGGTTTGTCAGTTCTTGGTGCTCTGTGTTCCCAGAGG 2340
                ************************************************************

185P3C2v.1      CAGGCGGAGGTTGAAGAAAGGAACCTGGGATGAGGGGTGCTGGGTATAAGCAGAGAGGGA 2210
185P3C2v.2      CAGGCGGAGGTTGAAGAAAGGAACCTGGGATGAGGGGTGCTGGGTATAAGCAGAGAGGGA 2099
185P3C2v.3      CAGGCGGAGGTTGAAGAAAGGAACCTGGGATGAGGGGTGCTGGGTATAAGCAGAGAGGGA 1944
185P3C2v.4      CAGGCGGAGGTTGAAGAAAGGAACCTGGGATGAGGGGTGCTGGGTATAAGCAGAGAGGGA 2195
185P3C2v.5      CAGGCGGAGGTTGAAGAAAGGAACCTGGGATGAGGGGTGCTGGGTATAAGCAGAGAGGGA 2400
                ************************************************************

185P3C2v.1      TGGGTTCCTGCTCCAAGGGACCCTTTGCCTTTCTTCTGCCCTTTCCTAGGCCCAGGCCTG 2270
```

Figure 13o (continued)

```
185P3C2v.2      TGGGTTCCTGCTCCAAGGGACCCTTTGCCTTTCTTCTGCCCTTTCCTAGGCCCAGGCCTG 2159
185P3C2v.3      TGGGTTCCTGCTCCAAGGGACCCTTTGCCTTTCTTCTGCCCTTTCCTAGGCCCAGGCCTG 2004
185P3C2v.4      TGGGTTCCTGCTCCAAGGGACCCTTTGCCTTTCTTCTGCCCTTTCCTAGGCCCAGGCCTG 2255
185P3C2v.5      TGGGTTCCTGCTCCAAGGGACCCTTTGCCTTTCTTCTGCCCTTTCCTAGGCCCAGGCCTG 2460
                ************************************************************

185P3C2v.1      GGTTTGTACTTCCACCTCCACCACATCTGCCAGACCTTAATAAAGGCCCCCACTTCTCCC 2330
185P3C2v.2      GGTTTGTACTTCCACCTCCACCACATCTGCCAGACCTTAATAAAGGCCCCCACTTCTCCC 2219
185P3C2v.3      GGTTTGTACTTCCACCTCCACCACATCTGCCAGACCTTAATAAAGGCCCCCACTTCTCCC 2064
185P3C2v.4      GGTTTGTACTTCCACCTCCACCACATCTGCCAGACCTTAATAAAGGCCCCCACTTCTCCC 2315
185P3C2v.5      GGTTTGTACTTCCACCTCCACCACATCTGCCAGACCTTAATAAAGGCCCCCACTTCTCCC 2520
                ************************************************************

185P3C2v.1      ATT 2333
185P3C2v.2      ATT 2222
185P3C2v.3      ATT 2067
185P3C2v.4      ATT 2318
185P3C2v.5      ATT 2523
                ***
```

Figure 14o Alignment of protein sequences of 185P3C2 transcript variants (SEQ ID NOS:54, 165, 166, 167, 168, 169).

```
185P3C2v.1      NCLLRPKNKSVRWGPGAGAALLRPSPAALGAGSRACSVPPAAPAQTPRPQVSAPAWGPGR 60
185P3C2v.2      NCLLRPKNKSVRWGPGAGAALLRPSPAALGAGSRACSVPPAAPAQTPRP----------- 49
185P3C2v.3A     NCLLRPKNKSVRWGPGAGAALLRPSPAALGAGSRACSVPPAAPAQTPRPQVSAPAWGPGR 60
185P3C2v.3B     ------------------------------------------------------------
185P3C2v.4      NCLLRPKNKSVRWGPGAGAALLRPSPAALGAGSRACSVPPAAPAQTPRPQVSAPAWGPGR 60
185P3C2v.5      ------------------------------------------------------------

185P3C2v.1      AARGSGRMERRMKAGYLDQQVPYTFSSKSPGNGSLREALIGPLGKLMDPGSLPPLDSEDL 120
185P3C2v.2      --------------------------QKSPGNGSLREALIGPLGKLMDPGSLPPLDSEDL 83
185P3C2v.3A     AARGSGRMERRMKAGYLDQQVPYTFSSKSPGNGSLREALIGPLGKLMDPGSLPPLDSEDL 120
185P3C2v.3B     ------------------------------------------------------------
185P3C2v.4      AARGSGRMERRMKAGYLDQQVPYTFSSKSPGNGSLREALIGPLGKLMDPGSLPPLDSEDL 120
185P3C2v.5      ----------------------------------------------MDPGSLPPLDSEDL 14
                                                              **************
```

Figure 14o (continued)

```
185P3C2v.1      FQDLSHFQETWLAEAQVPDSDEQFVPDFHSENLAFHSPTTRIKKEPQSPRTDPALSCSRK 180
185P3C2v.2      FQDLSHFQETWLAEAQVPDSDEQFVPDFHSENLAFHSPTTRIKKEPQSPRTDPALSCSRK 143
185P3C2v.3A     FQDLSHFQETWLAEAQVPDSDEQFVPDFHSENLAFHSPTTRIKKEPQSPRTDPALSCSRK 180
185P3C2v.3B     ------------------------------------------------------------
185P3C2v.4      FQDLSHFQETWLAEAQVPDSDEQFVPDFHSENLAFHSPTTRIKKEPQSPRTDPALSCSRK 180
185P3C2v.5      FQDLSHFQETWLAEAQVPDSDEQFVPDFHSENLAFHSPTTRIKKEPQSPRTDPALSCSRK 74
                ************************************************************

185P3C2v.1      PPLPYHHGEQCLYSSAYDPPRQIAIKSPAPGALGQSPLQPFPRAEQRNFLRSSGTSQPHP 240
185P3C2v.2      PPLPYHHGEQCLYSSAYDPPRQIAIKSPAPGALGQSPLQPFPRAEQRNFLRSSGTSQPHP 203
185P3C2v.3A     PPLPYHHGEQCLYSSAYDPPRQIAIKSPAPGALGQSPLQPFPRAEQRNFLRSSGTSQPHP 240
185P3C2v.3B     ------------------------------------------------MGTSG------ 5
185P3C2v.4      PPLPYHHGEQCLYSSAYDPPRQIAIKSPAPGALGQSPLQPFPRAEQRNFLRSSGTSQPHP 240
185P3C2v.5      PPLPYHHGEQCLYSSAYDPPRQIAIKSPAPGALGQSPLQPFPRAEQRNFLRSSGTSQPHP 134
                ************************************************************

185P3C2v.1      GHGYLGEHSSVFQQPLDICHSFTSQGGGREPLPAPYQHQLSEPCPPYPQQSFKQEYHDPL 300
185P3C2v.2      GHGYLGEHSSVFQQPLDICHSFTSQGGGREPLPAPYQHQLSEPCPPYPQQSFKQEYHDPL 263
185P3C2v.3A     GHGYLGEHR---------CHRVR------------------------------------- 254
185P3C2v.3B     ------------------------------------------------------------
185P3C2v.4      GHGYLGEHSSVFQQPLDICHSFTSQGGGREPLPAPYQHQLSEPCPPYPQQSFKQEYHDPL 300
185P3C2v.5      GHGYLGEHSSVFQQPLDICHSFTSQGGGREPLPAPYQHQLSEPCPPYPQQSFKQEYHDPL 194
                ********          **

185P3C2v.1      YEQAGQPAVDQGGVNGHRYPGAGVVIKQEQTDFAYDSDVTGCASMYLHTEGFSGPSPGDG 360
185P3C2v.2      YEQAGQPAVDQGGVNGHRYPGAGVVIKQEQTDFAYDSDVTGCASMYLHTEGFSGPSPGDG 323
185P3C2v.3A     --------------IN-------------------------------------------- 256
185P3C2v.3B     -----------------------------------NIDVTGCASMYLHTEGFSGPSPGDG 30
185P3C2v.4      YEQAGQPAVDQGGVNGHRYP------GAGVVIKQEQTDFAYDSDVTGCASMYLHTEGFSGP 355
185P3C2v.5      YEQAGQPAVDQGGVNGHRYPGAGVVIKQEQTDFAYDSDVTGCASMYLHTEGFSGPSPGDG 254
                              *

185P3C2v.1      AMGYGYEKPLRPFPDDVCVVPEKFEGDIKQEGVGAFREGPPYQRRGALQLWQFLVALLDD 420
185P3C2v.2      AMGYGYEKPLRPFPDDVCVVPEKFEGDIKQEGVGAFREGPPYQRRGALQLWQFLVALLDD 383
185P3C2v.3A     --------------------------------------VFPHR----------------- 261
185P3C2v.3B     AMGYGYEKPLRPFPDDVCVVPEKFEGDIKQEGVGAFREGPPYQRRGALQLWQFLVALLDD 90
185P3C2v.4      SPGYGYEKPLRPFPDDVCVVPEKFEGDIKQEGVGAFREGPPYQRRGALQLWQFLVALLDD 415
185P3C2v.5      AMGYGYEKPLRPFPDDVCVVPEKFEGDIKQEGVGAFREGPPYQRRGALQLWQFLVALLDD 314
                                                       **
```

Figure 14o (continued)

```
185P3C2v.1     PTNAHFIAWTGRGMEFKLIEPEEVARLWGIQKNRPAMNYDKLSRSLRYYYEKGIMQKVAG 480
185P3C2v.2     PTNAHFIAWTGRGMEFKLIEPEEVARLWGIQKNRPAMNYDKLSRSLRYYYEKGIMQKVAG 443
185P3C2v.3A    --------------------------GLLWALSR-------------------------- 269
185P3C2v.3B    PTNAHFIAWTGRGMEFKLIEPEEVARLWGIQKNRPAMNYDKLSRSLRYYYEKGIMQKVAG 150
185P3C2v.4     PTNAHFIAWTGRGMEFKLIEPEEVARLWGIQKNRPAMNYDKLSRSLRYYYEKGIMQKVAG 475
185P3C2v.5     PTNAHFIAWTGRGMEFKLIEPEEVARLWGIQKNRPAMNYDKLSRSLRYYYEKGIMQKVAG 374
                                                 **

185P3C2v.1     ERYVYKFVCEPEALFSLAFPDNQRPALKAEFDRFVSEEDTVPLSHLDESPAYLPELAGPA 540
185P3C2v.2     ERYVYKFVCEPEALFSLAFPDNQRPALKAEFDRFVSEEDTVPLSHLDESPAYLPELAGPA 503
185P3C2v.3A    ------------------------------------------------------------
185P3C2v.3B    ERYVYKFVCEPEALFSLAFPDNQRPALKAEFDRFVSEEDTVPLSHLDESPAYLPELAGPA 210
185P3C2v.4     ERYVYKFVCEPEALFSLAFPDNQRPALKAEFDRFVSEEDTVPLSHLDESPAYLPELAGPA 535
185P3C2v.5     ERYVYKFVCEPEALFSLAFPDNQRPALKAEFDRFVSEEDTVPLSHLDESPAYLPELAGPA 434

185P3C2v.1     QPFGPKGGYSY 551
185P3C2v.2     QPFGPKGGYSY 514
185P3C2v.3A    -----------
185P3C2v.3B    QPFGPKGGYSY 221
185P3C2v.4     QPFGPKGGYSY 546
185P3C2v.5     QPFGPKGGYSY 445
```

Figure 11r Nucleotide sequences of transcript variants of 192P2G7
>192P2G7 v.2 (SEQ ID NO:170).

```
ccacgcgtcc ggcgcgggcg cgggcgcggg cgcgtgcggg ctgcgagccg ggaggcggcg    60
gcggcgacgg cgacggcggc ggcatggcgg agagcgaggc cgagaccccc agcaccccgg   120
gggagttcga gagcaagtac ttcgagttcc atggcgtgcg gctgccgccc ttctgccgcg   180
ggaagatgga ggagatcgcc aacttcccgg tgcggcccag cgacgtgtgg atcgtcacct   240
accccaagtc cggaactgac ctctccccgc ctcatcaaga gccacctgcc ctaccgcttt   300
ctgccctctg acctccacaa tggagactcc aaggtcatct atatggctcg caaccccaag   360
gatctggtgg tgtcttatta tcagttccac cgctctctgc ggaccatgag ctaccgaggc   420
acctttcaag aattctgccg gaggtttatg aatgataagc tgggctacgg ctcctggttt   480
gagcacgtgc aggagttctg ggagcaccgc atggactcga acgtgctttt tctcaagtat   540
gaagacatgc atcgggacct ggtgacgatg gtggagcagc tggccagatt cctgggggtg   500
tcctgtgaca aggcccagct ggaagccctg acggagcact gccaccagct ggtggaccag   660
tgctgcaacg ctgaggccct gcccgtgggc cggggaagag ttgggctgtg gaaggacatc   720
```

Figure 11r (continued)

```
ttcaccgtct ccatgaatga gaagtttgac ttggtgtata aacagaagat gggaaagtgt      780
gacctcacgt ttgactttta tttataataa cagaaacaac aacctgcatg ctcacaatac      840
ccagacagtc tactagccaa aagtcctgta tgcattcatt tattccttgc tggacaaact      900
ctggaagcag cgtgtgaaac agcgggggaa gggaagagcg gcgtgagcgg agggagtgtg      960
atgattccca accgaaagca gctgtctcgc ctttagaacg tgcagcctct ccatgtctga     1020
ttacaaacag tctccacatt gcagttccaa tggcctggac cgtaaggata aagcctgtaa     1080
tatatgcaac tagaatgtct gccttttcaa ccccgtatta tttattgtat tttatagagc     1140
ttttcactgg aaatctacat aaatgtcagt aaaccaaata aaagttcatt tccaagggga     1200
atcaggagcg agccacaccc gaatggtaga aagatctcag ggttaactct ttatttttgt     1260
agttttatta tctaaggcac agccattctg ttctcacttg gttctgagat agtggtgaga     1320
acagaggatg agttgggtct gttgggggga atctggacac ttgtttattc tgacggagtt     1380
cacttcttca gaaccttcct gaaatgagca gaaattgttc actaggtctt cagaatggac     1440
gtccttctgc cagagacttc cagcgggcgg ctccaaaggc ccaatgcaga ggagcccgcg     1500
gagcatgtgc tgagggaagt ctgcctggtg aggctggcag gtgggagtct aatgcagtca     1560
ggagcatttg catgcagtgg gtggagagtc ggccaccaaa ggaccgagtt gcgctcggaa     1620
tttgagctga attccacagc cttactttgt ttcctgaagt gatagcctac taatgctggc     1680
aagcagatgc ttaatagtaa atttctaaaa tccccgggtc tttatcattc agtttgttct     1740
gtgcacctga ggcgctcagc cgtgggagga ccattttgcg agtgtagccc tgtttcactc     1800
ggatcaggtt ggcacggccg cctgcgtgtc tgtccacctc atccctccgt gtatctgagg     1860
gagtaaaggt gaggtcttta ttgcttcact gcctaatttt ctcacccaca ttcgctgaag     1920
cgatggagag tcgggggcca gtagccagcc aaccccgtgg ggaccggggt tgtctgtcat     1980
ttatgtggct ggaaagcacc caaagtggtg gtcaggaggg tcgctgctgt ggaaggggtc     2040
tccgttcttg gtgctgtatt tgaaacgggt gtagagagaa gcttgtgttt ttgtttgtaa     2100
tggggagaag cgtggccagg cagtggcacg tggcatcgca tggtgggctc ggcagcacct     2160
tgcctgtgtt tctgtgaggg aggctgcttt ctgtgaaatt tctttatatt tttctatttt     2220
tagtactgta tggatgttac tgagcactac acatgatcct tctgtgcttg cttgcatctt     2280
taataaagac atgttcccgg caaaaaaaaa aaaaaaaaaa aaaaaaaaaa aaaaaaaaaa     2340
aaaaaaaaaa aaaaaaaaaa aaaa                                            2364
```

>192P2G7 v.3 (SEQ ID NO:171).

```
ccacgcgtcc ggcgcgggcg cgggcgcggg cgcgtgcggg ctgcgagccg ggaggcggcg       60
gcggcgacgg cgacggcggc ggcatggcgg agagcgaggc cgagaccccc agcacccccgg     120
gggagttcga gagcaagtac ttcgagttcc atggcgtgcg gctgccgccc ttctgccgcg      180
ggaagatgga ggagatcgcc aacttcccgg tgcggcccag cgacgtgtgg atcgtcacct      240
accccaagtc cgtgggctac ggctcctggt ttgagcacgt gcaggagttc tgggagcacc      300
gcatggactc gaacgtgctt tttctcaagt atgaagacat gcatcgggac ctggtgacga      360
tggtggagca gctggccaga ttcctggggg tgtcctgtga caaggcccag ctggaagccc      420
tgacggagca ctgccaccag ctggtggacc agtgctgcaa cgctgaggcc ctgcccgtgg      480
gccggggaag agttgggctg tggaaggaca tcttcaccgt ctccatgaat gagaagtttg      540
```

```
acttggtgta taaacagaag atgggaaagt gtgacctcac gtttgacttt tatttataat      600
aacagaaaca acaacctgca tgctcacaat acccagacag tctactagcc aaaagtcctg      660
tatgcattca tttattcctt gctggacaaa ctctggaagc agcgtgtgaa acagcggggg      720
aagggaagag cggcgtgagc ggagggagtg tgatgattcc caaccgaaag cagctgtctc      780
gcctttagaa cgtgcagcct ctccatgtct gattacaaac agtctccaca ttgcagttcc      840
aatggcctgg accgtaagga taaagcctgt aatatatgca actagaatgt ctgccttttc      900
aaccccgtat tatttattgt attttataga gcttttcact ggaaatctac ataaatgtca      960
gtaaaccaaa taaaagttca tttccaaggg gaatcaggag cgagccacac ccgaatggta     1020
gaaagatctc agggttaact ctttattttt gtagttttat tatctaaggc acagccattc     1080
tgttctcact tggttctgag atagtggtga gaacagagga tgagttgggt ctgttggggg     1140
gaatctggac acttgtttat tctgacggag ttcacttctt cagaaccttc ctgaaatgag     1200
cagaaattgt tcactaggtc ttcagaatgg acgtccttct gccagagact tccagcgggc     1260
ggctccaaag gcccaatgca gaggagcccg cggagcatgt gctgagggaa gtctgcctgg     1320
tgaggctggc aggtgggagt ctaatgcagt caggagcatt tgcatgcagt gggtggagag     1380
tcggccacca aaggaccgag ttgcgctcgg aatttgagct gaattccaca gccttacttt     1440
gtttcctgaa gtgatagcct actaatgctg gcaagcagat gcttaatagt aaatttctaa     1500
aatccccggg tctttatcat tcagtttgtt ctgtgcacct gaggcgctca gccgtgggag     1560
gaccattttg cgagtgtagc cctgtttcac tcggatcagg ttggcacggc cgcctgcgtg     1620
tctgtccacc tcatccctcc gtgtatctga gggagtaaag gtgaggtctt tattgcttca     1680
ctgcctaatt ttctcaccca cattcgctga agcgatggag agtcgggggc cagtagccag     1740
ccaaccccgt ggggaccggg gttgtctgtc atttatgtgg ctggaaagca cccaaagtgg     1800
tggtcaggag ggtcgctgct gtggaagggg tctccgttct tggtgctgta tttgaaacgg     1860
gtgtagagag aagcttgtgt ttttgtttgt aatggggaga agcgtggcca ggcagtggca     1920
cgtggcatcg catggtgggc tcggcagcac cttgcctgtg tttctgtgag ggaggctgct     1980
ttctgtgaaa tttctttata tttttctatt tttagtactg tatggatgtt actgagcact     2040
acacatgatc cttctgtgct tgcttgcatc tttaataaag acatgttccc ggcaaaaaaa     2100
aaaaaaaaaa aaaaaaaaaa aaaaaaaaaa aaaaaaaaaa aaaaaaaaaa aaaaaa         2156
```

Figure 12r Protein sequences of transcript variants of 192P2G7

>192P2G7 v.2 (SEQ ID NO:172).

```
MACGCRPSAA GRWRRSPTSR CGPATCGSSP TPSPELTSPR LIKSHLPYRF LPSDLHNGDS       60
KVIYMARNPK DLVVSYYQFH RSLRTMSYRG TFQEFCRRFM NDKLGYGSWF EHVQEFWEHR      120
MDSNVLFLKY EDMHRDLVTM VEQLARFLGV SCDKAQLEAL TEHCHQLVDQ CCNAEALPVG      180
RGRVGLWKDI FTVSMNEKFD LVYKQKMGKC DLTFDFYL                             218
```

>192P2G7 v.3 (SEQ ID NO 173).

```
MAESEAETPS TPGEFESKYF EFHGVRLPPF CRGKMEEIAN FPVRPSDVWI VTYPKSVGYG       60
SWFEHVQEFW EHRMDSNVLF LKYEDMHRDL VTMVEQLARF LGVSCDKAQL EALTEHCHQL      120
VDQCCNAEAL PVGRGRVGLW KDIFTVSMNE KFDLVYKQKM GKCDLTFDFY L               171
```

Figure 13r Alignment of nucleotide sequences of 192P2G7 transcript variants (SEQ ID NOS: 59, 170, 171).

```
192P2G7v.1      CCACGCGTCCGGCGCGGGCGCGGGCGCGGGCGCGTGCGGGCTGCGAGCCGGGAGGCGGCG 60
192P2G7v.2      CCACGCGTCCGGCGCGGGCGCGGGCGCGGGCGCGTGCGGGCTGCGAGCCGGGAGGCGGCG 60
192P2G7v.3      CCACGCGTCCGGCGCGGGCGCGGGCGCGGGCGCGTGCGGGCTGCGAGCCGGGAGGCGGCG 60
                ************************************************************

192P2G7v.1      GCGGCGACGGCGACGGCGGCGGCATGGCGGAGAGCGAGGCCGAGACCCCCAGCACCCCGG 120
192P2G7v.2      GCGGCGACGGCGACGGCGGCGGCATGGCGGAGAGCGAGGCCGAGACCCCCAGCACCCCGG 120
192P2G7v.3      GCGGCGACGGCGACGGCGGCGGCATGGCGGAGAGCGAGGCCGAGACCCCCAGCACCCCGG 120
                ************************************************************

192P2G7v.1      GGGAGTTCGAGAGCAAGTACTTCGAGTTCCATGGCGTGCGGCTGCCGCCCTTCTGCCGCG 180
192P2G7v.2      GGGAGTTCGAGAGCAAGTACTTCGAGTTCCATGGCGTGCGGCTGCCGCCCTTCTGCCGCG 180
192P2G7v.3      GGGAGTTCGAGAGCAAGTACTTCGAGTTCCATGGCGTGCGGCTGCCGCCCTTCTGCCGCG 180
                ************************************************************

192P2G7v.1      GGAAGATGGAGGAGATCGCCAACTTCCCGGTGCGGCCCAGCGACGTGTGGATCGTCACCT 240
192P2G7v.2      GGAAGATGGAGGAGATCGCCAACTTCCCGGTGCGGCCCAGCGACGTGTGGATCGTCACCT 240
192P2G7v.3      GGAAGATGGAGGAGATCGCCAACTTCCCGGTGCGGCCCAGCGACGTGTGGATCGTCACCT 240
                ************************************************************

192P2G7v.1      ACCCCAAGTCCGGCACCAGCTTGCTGCAGGAGGTGGTCTACTTGGTGAGCCAGGGCGCTG 300
192P2G7v.2      ACCCCAAGTCCG------------------------------------------------ 252
192P2G7v.3      ACCCCAAGTCCG------------------------------------------------ 252
                ************

192P2G7v.1      ACCCCGATGAGATCGGCTTGATGAACATCGACGAGCAGCTCCCGGTCCTGGAGTACCCAC 360
192P2G7v.2      ------------------------------------------------------------
192P2G7v.3      ------------------------------------------------------------

192P2G7v.1      AGCCGGGCCTGGACATCATCAAGGAACTGACCTCTCCCCGCCTCATCAAGAGCCACCTGC 420
192P2G7v.2      -----------------------GAACTGACCTCTCCCCGCCTCATCAAGAGCCACCTGC 289
192P2G7v.3      ------------------------------------------------------------

192P2G7v.1      CCTACCGCTTTCTGCCCTCTGACCTCCACAATGGAGACTCCAAGGTCATCTATATGGCTC 480
192P2G7v.2      CCTACCGCTTTCTGCCCTCTGACCTCCACAATGGAGACTCCAAGGTCATCTATATGGCTC 349
192P2G7v.3      ------------------------------------------------------------
```

Figure 13r (continued)

```
192P2G7v.1      GCAACCCCAAGGATCTGGTGGTGTCTTATTATCAGTTCCACCGCTCTCTGCGGACCATGA 540
192P2G7v.2      GCAACCCCAAGGATCTGGTGGTGTCTTATTATCAGTTCCACCGCTCTCTGCGGACCATGA 409
192P2G7v.3      ------------------------------------------------------------

192P2G7v.1      GCTACCGAGGCACCTTTCAAGAATTCTGCCGGAGGTTTATGAATGATAAGCTGGGCTACG 600
192P2G7v.2      GCTACCGAGGCACCTTTCAAGAATTCTGCCGGAGGTTTATGAATGATAAGCTGGGCTACG 469
192P2G7v.3      ---------------------------------------------------TGGGCTACG 261
                                                                   *********

192P2G7v.1      GCTCCTGGTTTGAGCACGTGCAGGAGTTCTGGGAGCACCGCATGGACTCGAACGTGCTTT 660
192P2G7v.2      GCTCCTGGTTTGAGCACGTGCAGGAGTTCTGGGAGCACCGCATGGACTCGAACGTGCTTT 529
192P2G7v.3      GCTCCTGGTTTGAGCACGTGCAGGAGTTCTGGGAGCACCGCATGGACTCGAACGTGCTTT 321
                ************************************************************

192P2G7v.1      TTCTCAAGTATGAAGACATGCATCGGGACCTGGTGACGATGGTGGAGCAGCTGGCCAGAT 720
192P2G7v.2      TTCTCAAGTATGAAGACATGCATCGGGACCTGGTGACGATGGTGGAGCAGCTGGCCAGAT 589
192P2G7v.3      TTCTCAAGTATGAAGACATGCATCGGGACCTGGTGACGATGGTGGAGCAGCTGGCCAGAT 381
                ************************************************************

192P2G7v.1      TCCTGGGGGTGTCCTGTGACAAGGCCCAGCTGGAAGCCCTGACGGAGCACTGCCACCAGC 780
192P2G7v.2      TCCTGGGGGTGTCCTGTGACAAGGCCCAGCTGGAAGCCCTGACGGAGCACTGCCACCAGC 649
192P2G7v.3      TCCTGGGGGTGTCCTGTGACAAGGCCCAGCTGGAAGCCCTGACGGAGCACTGCCACCAGC 441
                ************************************************************

192P2G7v.1      TGGTGGACCAGTGCTGCAACGCTGAGGCCCTGCCCGTGGGCCGGGGAAGAGTTGGGCTGT 840
192P2G7v.2      TGGTGGACCAGTGCTGCAACGCTGAGGCCCTGCCCGTGGGCCGGGGAAGAGTTGGGCTGT 709
192P2G7v.3      TGGTGGACCAGTGCTGCAACGCTGAGGCCCTGCCCGTGGGCCGGGGAAGAGTTGGGCTGT 501
                ************************************************************

192P2G7v.1      GGAAGGACATCTTCACCGTCTCCATGAATGAGAAGTTTGACTTGGTGTATAAACAGAAGA 900
192P2G7v.2      GGAAGGACATCTTCACCGTCTCCATGAATGAGAAGTTTGACTTGGTGTATAAACAGAAGA 769
192P2G7v.3      GGAAGGACATCTTCACCGTCTCCATGAATGAGAAGTTTGACTTGGTGTATAAACAGAAGA 561
                ************************************************************

192P2G7v.1      TGGGAAAGTGTGACCTCACGTTTGACTTTTATTTATAATAACAGAAACAACAACCTGCAT 960
192P2G7v.2      TGGGAAAGTGTGACCTCACGTTTGACTTTTATTTATAATAACAGAAACAACAACCTGCAT 829
```

Figure 13r (continued)

```
192P2G7v.3      TGGGAAAGTGTGACCTCACGTTTGACTTTTATTTATAATAACAGAAACAACAACCTGCAT 621
                ************************************************************

192P2G7v.1      GCTCACAATACCCAGACAGTCTACTAGCCAAAAGTCCTGTATGCATTCATTTATTCCTTG 1020
192P2G7v.2      GCTCACAATACCCAGACAGTCTACTAGCCAAAAGTCCTGTATGCATTCATTTATTCCTTG 889
192P2G7v.3      GCTCACAATACCCAGACAGTCTACTAGCCAAAAGTCCTGTATGCATTCATTTATTCCTTG 681
                ************************************************************

192P2G7v.1      CTGGACAAACTCTGGAAGCAGCGTGTGAAACAGCGGGGGAAGGGAAGAGCGGCGTGAGCG 1080
192P2G7v.2      CTGGACAAACTCTGGAAGCAGCGTGTGAAACAGCGGGGGAAGGGAAGAGCGGCGTGAGCG 949
192P2G7v.3      CTGGACAAACTCTGGAAGCAGCGTGTGAAACAGCGGGGGAAGGGAAGAGCGGCGTGAGCG 741
                ************************************************************

192P2G7v.1      GAGGGAGTGTGATGATTCCCAACCGAAAGCAGCTGTCTCGCCTTTAGAACGTGCAGCCTC 1140
192P2G7v.2      GAGGGAGTGTGATGATTCCCAACCGAAAGCAGCTGTCTCGCCTTTAGAACGTGCAGCCTC 1009
192P2G7v.3      GAGGGAGTGTGATGATTCCCAACCGAAAGCAGCTGTCTCGCCTTTAGAACGTGCAGCCTC 801
                ************************************************************

192P2G7v.1      TCCATGTCTGATTACAAACAGTCTCCACATTGCAGTTCCAATGGCCTGGACCGTAAGGAT 1200
192P2G7v.2      TCCATGTCTGATTACAAACAGTCTCCACATTGCAGTTCCAATGGCCTGGACCGTAAGGAT 1069
192P2G7v.3      TCCATGTCTGATTACAAACAGTCTCCACATTGCAGTTCCAATGGCCTGGACCGTAAGGAT 861
                ************************************************************

192P2G7v.1      AAAGCCTGTAATATATGCAACTAGAATGTCTGCCTTTTCAACCCCGTATTATTTATTGTA 1260
192P2G7v.2      AAAGCCTGTAATATATGCAACTAGAATGTCTGCCTTTTCAACCCCGTATTATTTATTGTA 1129
192P2G7v.3      AAAGCCTGTAATATATGCAACTAGAATGTCTGCCTTTTCAACCCCGTATTATTTATTGTA 921
                ************************************************************

192P2G7v.1      TTTTATAGAGCTTTTCACTGGAAATCTACATAAATGTCAGTAAACCAAATAAAAGTTCAT 1320
192P2G7v.2      TTTTATAGAGCTTTTCACTGGAAATCTACATAAATGTCAGTAAACCAAATAAAAGTTCAT 1189
192P2G7v.3      TTTTATAGAGCTTTTCACTGGAAATCTACATAAATGTCAGTAAACCAAATAAAAGTTCAT 981
                ************************************************************

192P2G7v.1      TTCCAAGGGGAATCAGGAGCGAGCCACACCCGAATGGTAGAAAGATCTCAGGGTTAACTC 1380
192P2G7v.2      TTCCAAGGGGAATCAGGAGCGAGCCACACCCGAATGGTAGAAAGATCTCAGGGTTAACTC 1249
192P2G7v.3      TTCCAAGGGGAATCAGGAGCGAGCCACACCCGAATGGTAGAAAGATCTCAGGGTTAACTC 1041
                ************************************************************

192P2G7v.1      TTTATTTTTGTAGTTTTATTATCTAAGGCACAGCCATTCTGTTCTCACTTGGTTCTGAGA 1440
```

Figure 13r (continued)

```
192P2G7v.2      TTTATTTTTGTAGTTTTATTATCTAAGGCACAGCCATTCTGTTCTCACTTGGTTCTGAGA 1309
192P2G7v.3      TTTATTTTTGTAGTTTTATTATCTAAGGCACAGCCATTCTGTTCTCACTTGGTTCTGAGA 1101
                ************************************************************

192P2G7v.1      TAGTGGTGAGAACAGAGGATGAGTTGGGTCTGTTGGGGGGAATCTGGACACTTGTTTATT 1500
192P2G7v.2      TAGTGGTGAGAACAGAGGATGAGTTGGGTCTGTTGGGGGGAATCTGGACACTTGTTTATT 1369
192P2G7v.3      TAGTGGTGAGAACAGAGGATGAGTTGGGTCTGTTGGGGGGAATCTGGACACTTGTTTATT 1161
                ************************************************************

192P2G7v.1      CTGACGGAGTTCACTTCTTCAGAACCTTCCTGAAATGAGCAGAAATTGTTCACTAGGTCT 1560
192P2G7v.2      CTGACGGAGTTCACTTCTTCAGAACCTTCCTGAAATGAGCAGAAATTGTTCACTAGGTCT 1429
192P2G7v.3      CTGACGGAGTTCACTTCTTCAGAACCTTCCTGAAATGAGCAGAAATTGTTCACTAGGTCT 1221
                ************************************************************

192P2G7v.1      TCAGAATGGACGTCCTTCTGCCAGAGACTTCCAGCGGGCGGCTCCAAAGGCCCAATGCAG 1620
192P2G7v.2      TCAGAATGGACGTCCTTCTGCCAGAGACTTCCAGCGGGCGGCTCCAAAGGCCCAATGCAG 1489
192P2G7v.3      TCAGAATGGACGTCCTTCTGCCAGAGACTTCCAGCGGGCGGCTCCAAAGGCCCAATGCAG 1281
                ************************************************************

192P2G7v.1      AGGAGCCCGCGGAGCATGTGCTGAGGGAAGTCTGCCTGGTGAGGCTGGCAGGTGGGAGTC 1680
192P2G7v.2      AGGAGCCCGCGGAGCATGTGCTGAGGGAAGTCTGCCTGGTGAGGCTGGCAGGTGGGAGTC 1549
192P2G7v.3      AGGAGCCCGCGGAGCATGTGCTGAGGGAAGTCTGCCTGGTGAGGCTGGCAGGTGGGAGTC 1341
                ************************************************************

192P2G7v.1      TAATGCAGTCAGGAGCATTTGCATGCAGTGGGTGGAGAGTCGGCCACCAAAGGACCGAGT 1740
192P2G7v.2      TAATGCAGTCAGGAGCATTTGCATGCAGTGGGTGGAGAGTCGGCCACCAAAGGACCGAGT 1609
192P2G7v.3      TAATGCAGTCAGGAGCATTTGCATGCAGTGGGTGGAGAGTCGGCCACCAAAGGACCGAGT 1401
                ************************************************************

192P2G7v.1      TGCGCTCGGAATTTGAGCTGAATTCCACAGCCTTACTTTGTTTCCTGAAGTGATAGCCTA 1800
192P2G7v.2      TGCGCTCGGAATTTGAGCTGAATTCCACAGCCTTACTTTGTTTCCTGAAGTGATAGCCTA 1669
192P2G7v.3      TGCGCTCGGAATTTGAGCTGAATTCCACAGCCTTACTTTGTTTCCTGAAGTGATAGCCTA 1461
                ************************************************************

192P2G7v.1      CTAATGCTGGCAAGCAGATGCTTAATAGTAAATTTCTAAAATCCCCGGGTCTTTATCATT 1860
192P2G7v.2      CTAATGCTGGCAAGCAGATGCTTAATAGTAAATTTCTAAAATCCCCGGGTCTTTATCATT 1729
192P2G7v.3      CTAATGCTGGCAAGCAGATGCTTAATAGTAAATTTCTAAAATCCCCGGGTCTTTATCATT 1521
                ************************************************************
```

Figure 13r (continued)

```
192P2G7v.1      CAGTTTGTTCTGTGCACCTGAGGCGCTCAGCCGTGGGAGGACCATTTTGCGAGTGTAGCC 1920
192P2G7v.2      CAGTTTGTTCTGTGCACCTGAGGCGCTCAGCCGTGGGAGGACCATTTTGCGAGTGTAGCC 1789
192P2G7v.3      CAGTTTGTTCTGTGCACCTGAGGCGCTCAGCCGTGGGAGGACCATTTTGCGAGTGTAGCC 1581
                ************************************************************

192P2G7v.1      CTGTTTCACTCGGATCAGGTTGGCACGGCCGCCTGCGTGTCTGTCCACCTCATCCCTCCG 1980
192P2G7v.2      CTGTTTCACTCGGATCAGGTTGGCACGGCCGCCTGCGTGTCTGTCCACCTCATCCCTCCG 1849
192P2G7v.3      CTGTTTCACTCGGATCAGGTTGGCACGGCCGCCTGCGTGTCTGTCCACCTCATCCCTCCG 1641
                ************************************************************

192P2G7v.1      TGTATCTGAGGGAGTAAAGGTGAGGTCTTTATTGCTTCACTGCCTAATTTTCTCACCCAC 2040
192P2G7v.2      TGTATCTGAGGGAGTAAAGGTGAGGTCTTTATTGCTTCACTGCCTAATTTTCTCACCCAC 1909
192P2G7v.3      TGTATCTGAGGGAGTAAAGGTGAGGTCTTTATTGCTTCACTGCCTAATTTTCTCACCCAC 1701
                ************************************************************

192P2G7v.1      ATTCGCTGAAGCGATGGAGAGTCGGGGGCCAGTAGCCAGCCAACCCCGTGGGGACCGGGG 2100
192P2G7v.2      ATTCGCTGAAGCGATGGAGAGTCGGGGGCCAGTAGCCAGCCAACCCCGTGGGGACCGGGG 1969
192P2G7v.3      ATTCGCTGAAGCGATGGAGAGTCGGGGGCCAGTAGCCAGCCAACCCCGTGGGGACCGGGG 1761
                ************************************************************

192P2G7v.1      TTGTCTGTCATTTATGTGGCTGGAAAGCACCCAAAGTGGTGGTCAGGAGGGTCGCTGCTG 2160
192P2G7v.2      TTGTCTGTCATTTATGTGGCTGGAAAGCACCCAAAGTGGTGGTCAGGAGGGTCGCTGCTG 2029
192P2G7v.3      TTGTCTGTCATTTATGTGGCTGGAAAGCACCCAAAGTGGTGGTCAGGAGGGTCGCTGCTG 1821
                ************************************************************

192P2G7v.1      TGGAAGGGGTCTCCGTTCTTGGTGCTGTATTTGAAACGGGTGTAGAGAGAAGCTTGTGTT 2220
192P2G7v.2      TGGAAGGGGTCTCCGTTCTTGGTGCTGTATTTGAAACGGGTGTAGAGAGAAGCTTGTGTT 2089
192P2G7v.3      TGGAAGGGGTCTCCGTTCTTGGTGCTGTATTTGAAACGGGTGTAGAGAGAAGCTTGTGTT 1881
                ************************************************************

192P2G7v.1      TTTGTTTGTAATGGGGAGAAGCGTGGCCAGGCAGTGGCACGTGGCATCGCATGGTGGGCT 2280
192P2G7v.2      TTTGTTTGTAATGGGGAGAAGCGTGGCCAGGCAGTGGCACGTGGCATCGCATGGTGGGCT 2149
192P2G7v.3      TTTGTTTGTAATGGGGAGAAGCGTGGCCAGGCAGTGGCACGTGGCATCGCATGGTGGGCT 1941
                ************************************************************

192P2G7v.1      CGGCAGCACCTTGCCTGTGTTTCTGTGAGGGAGGCTGCTTTCTGTGAAATTTCTTTATAT 2340
192P2G7v.2      CGGCAGCACCTTGCCTGTGTTTCTGTGAGGGAGGCTGCTTTCTGTGAAATTTCTTTATAT 2209
192P2G7v.3      CGGCAGCACCTTGCCTGTGTTTCTGTGAGGGAGGCTGCTTTCTGTGAAATTTCTTTATAT 2001
                ************************************************************
```

Figure 13r (continued)

```
192P2G7v.1      TTTTCTATTTTTAGTACTGTATGGATGTTACTGAGCACTACACATGATCCTTCTGTGCTT 2400
192P2G7v.2      TTTTCTATTTTTAGTACTGTATGGATGTTACTGAGCACTACACATGATCCTTCTGTGCTT 2269
192P2G7v.3      TTTTCTATTTTTAGTACTGTATGGATGTTACTGAGCACTACACATGATCCTTCTGTGCTT 2061
                ************************************************************

192P2G7v.1      GCTTGCATCTTTAATAAAGACATGTTCCCGGCAAAAAAAAAAAAAAAAAAAAAAAAAAAA 2460
192P2G7v.2      GCTTGCATCTTTAATAAAGACATGTTCCCGGCAAAAAAAAAAAAAAAAAAAAAAAAAAAA 2329
192P2G7v.3      GCTTGCATCTTTAATAAAGACATGTTCCCGGCAAAAAAAAAAAAAAAAAAAAAAAAAAAA 2121
                ************************************************************

192P2G7v.1      AAAAAAAAAAAAAAAAAAAAAAAAAAAAAAAAAAA 2495
192P2G7v.2      AAAAAAAAAAAAAAAAAAAAAAAAAAAAAAAAAAA 2364
192P2G7v.3      AAAAAAAAAAAAAAAAAAAAAAAAAAAAAAAAAAA 2156
                ***********************************
```

Figure 14r Alignment of protein sequences of 192P2G7 transcript variants (SEQ ID NOS:60, 172, 173).

```
192P2G7v.1      --------------------MAESEAETPSTPG-EFES-KYFEFHG-VRLPP-------- 29
192P2G7v.2      MACGCRPSAAGRWRRSPTSRCGPATCGSSPTPSPELTSPRLIKSHLPYRFLPSDLHNGDS 60
192P2G7v.3      --------------------MAESEAETPSTPG-EFES-KYFEFHG-VRLPP-------- 29
                                              **  *  *       *   *   *

192P2G7v.1      ----FCRGKMEEIANFPVRPSDVWIVTYPKSGTSLLQEVVYLVSQGADPDEIGLMNIDEQ 85
192P2G7v.2      KVIYMARNPKDLVVSYYQFHRSLRTMSYRGTFQEFCRRFMN------------------- 101
192P2G7v.3      ----FCRGKMEEIANFPVRPSDVWIVTYPKS----------------------------- 56
                     *                    *

192P2G7v.1      LPVLEYPQPGLDIIKELTSPRLIKSHLPYRFLPSDLHNGDSKVIYMARNPKDLVVSYYQF 145
192P2G7v.2      ------------------------------------------------------------
192P2G7v.3      ------------------------------------------------------------

192P2G7v.1      HRSLRTMSYRGTFQEFCRRFMNDKLGYGSWFEHVQEFWEHRMDSNVLFLKYEDMHRDLVT 205
192P2G7v.2      ----------------------DKLGYGSWFEHVQEFWEHRMDSNVLFLKYEDMHRDLVT 139
192P2G7v.3      ------------------------VGYGSWFEHVQEFWEHRMDSNVLFLKYEDMHRDLVT 92
                                         ***********************************

192P2G7v.1      MVEQLARFLGVSCDKAQLEALTEHCHQLVDQCCNAEALPVGRGRVGLWKDIFTVSMNEKF 265
```

Figure 14r (continued)

```
192P2G7v.2      MVEQLARFLGVSCDKAQLEALTEHCHQLVDQCCNAEALPVGRGRVGLWKDIFTVSMNEKF 199
192P2G7v.3      MVEQLARFLGVSCDKAQLEALTEHCHQLVDQCCNAEALPVGRGRVGLWKDIFTVSMNEKF 152
                ************************************************************

192P2G7v.1      DLVYKQKMGKCDLTFDFYL 284
192P2G7v.2      DLVYKQKMGKCDLTFDFYL 218
192P2G7v.3      DLVYKQKMGKCDLTFDFYL 171
                *******************
```

Figure 15 Expression of 74P3B3 by RT-PCR
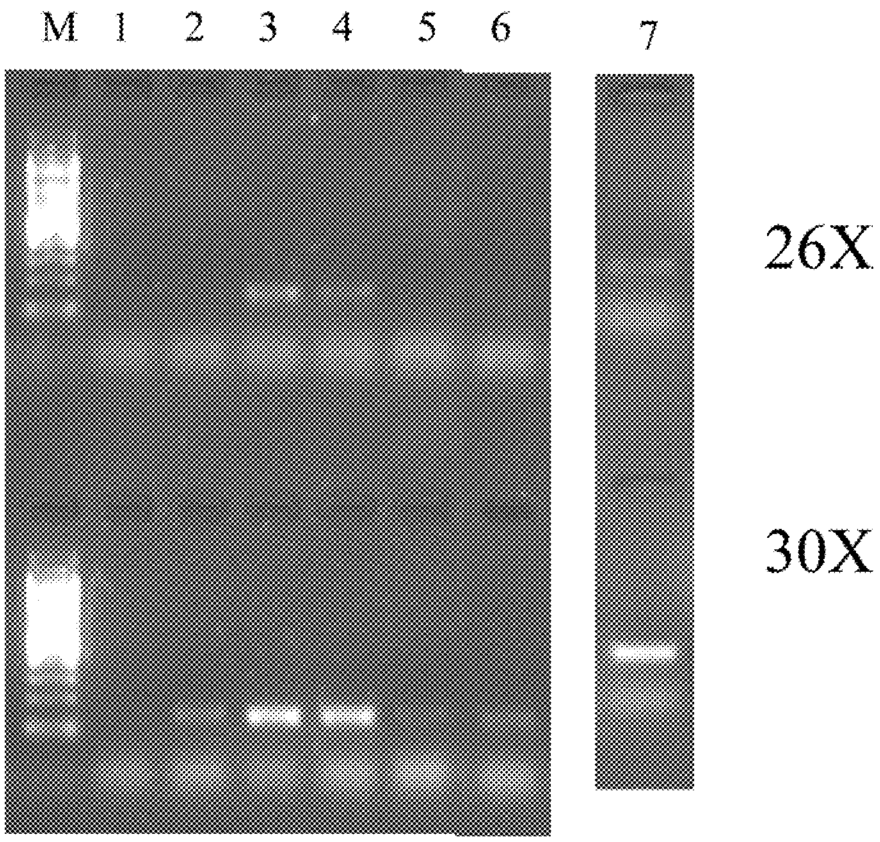
M= Marker
1. Vital pool 1
2. Vital pool 2
3. Prostate metastasis to LN #1
4. Prostate cancer pool
5. Bladder cancer pool
6. Cancer metastasis pool
7. Prostate metastasis to LN #2

Figure 16 Expression of 74P3B3 in Normal Tissues and Prostate Cancer Xenografts
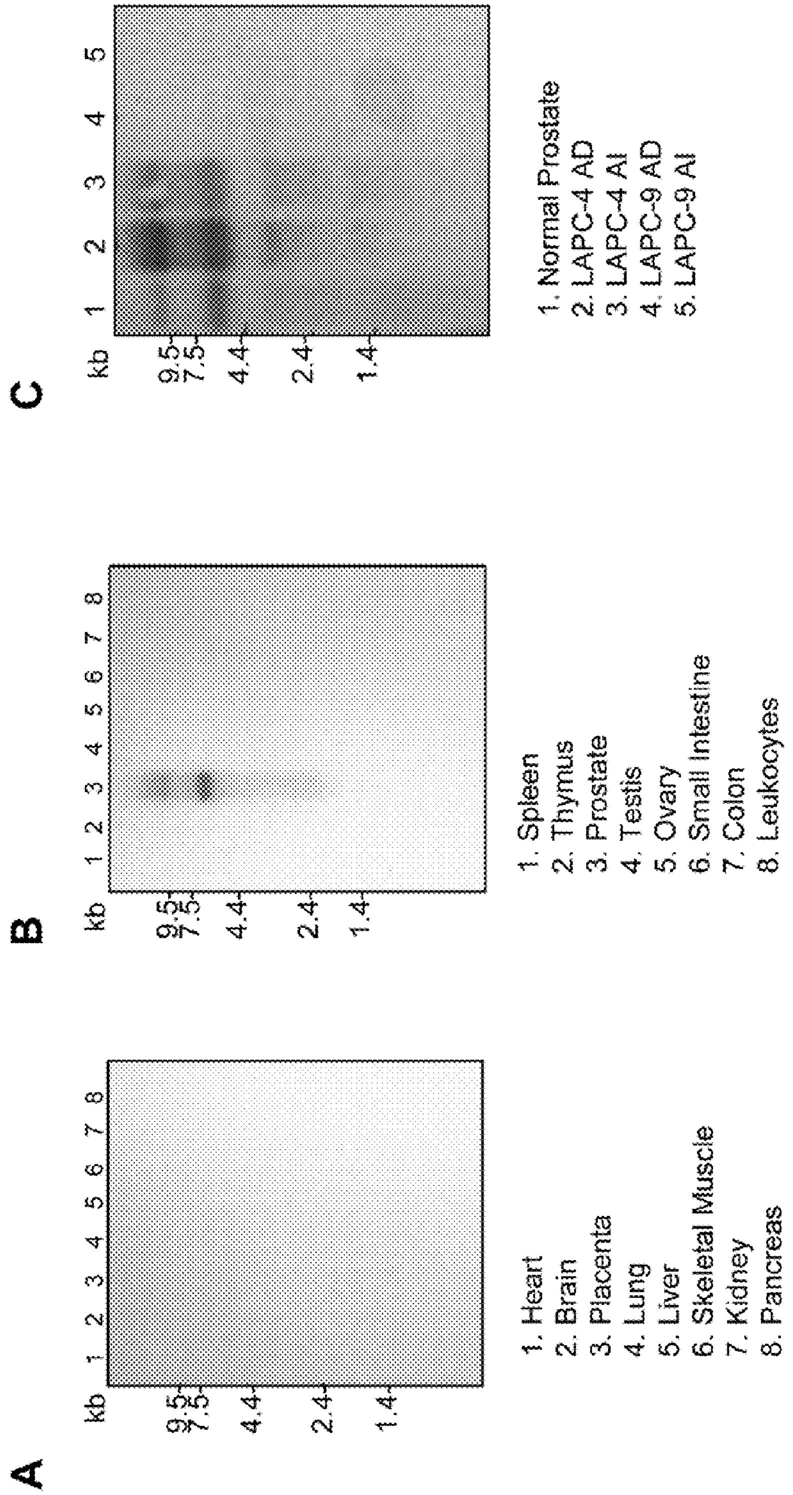

Figure 17 Expression of 74P3B3 in Prostate Cancer Patient Specimens
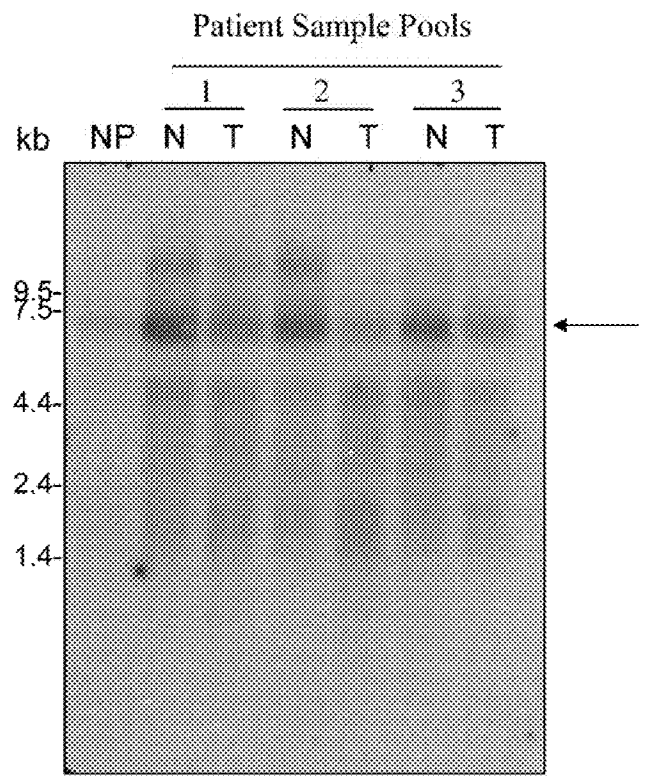
Patient Sample Pools:
Pool 1: 3 samples of Gleason score 6
Pool 2: 3 samples of Gleason score 7
Pool 3: 3 samples of Gleason score 9
*NP = Normal Prostate*
*N = Normal Adjacent tissue*
*T = Tumor*

Figure 18 Expression of 74P3B3 in Patient Cancer Specimens
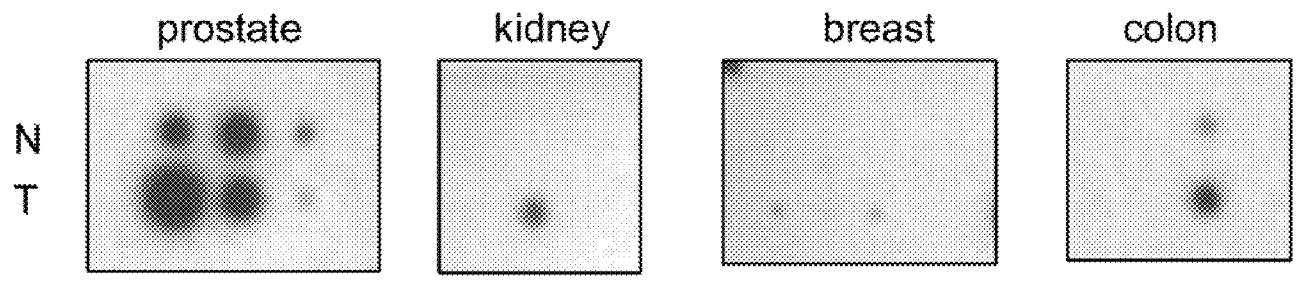
*T = tumor RNA*
*N = normal adjacent tissue RNA*

Figure 19 Expression of 83P4B8 by RT-PCR
M = Marker
1. Vital pool 1
2. Vital pool 2
3. Prostate cancer pool
4. Bladder cancer pool
5. Kidney cancer pool
6. Colon cancer pool
7. Lung cancer pool
8. Ovary cancer pool
9. Breast cancer pool
10. Cancer metastasis pool
11. Pancreas cancer pool
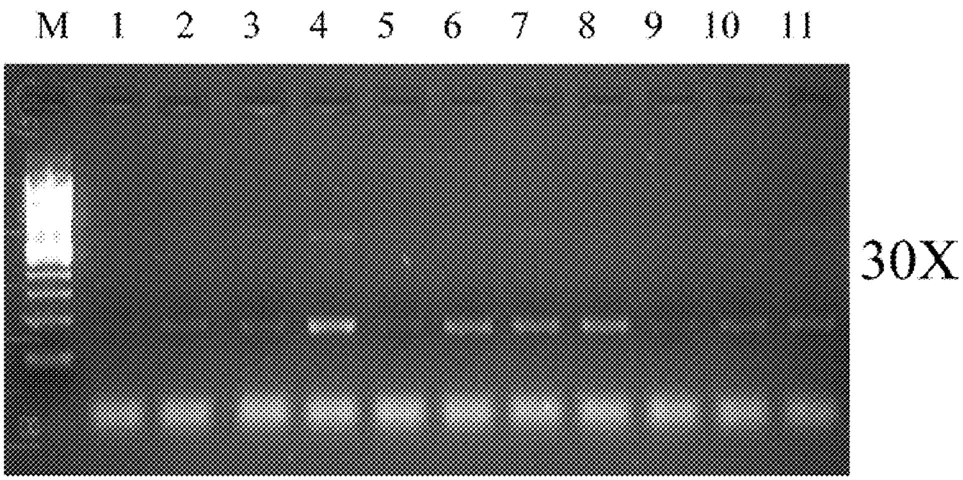

Figure 20 Expression of 83P4B8 in Normal Tissues
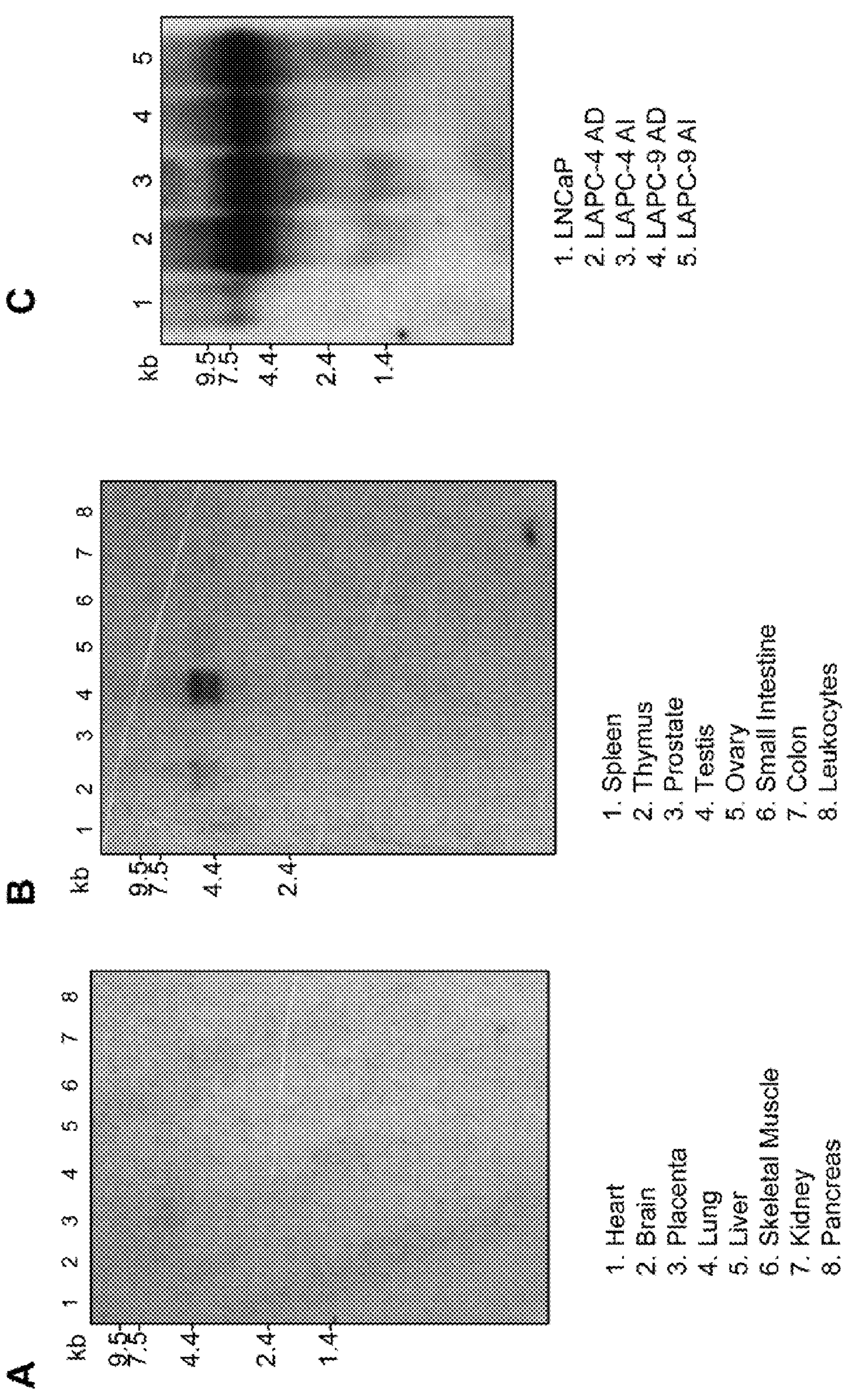

Figure 21 Expression of 83P4B8 in Patient Cancer Specimens and in Normal Tissues

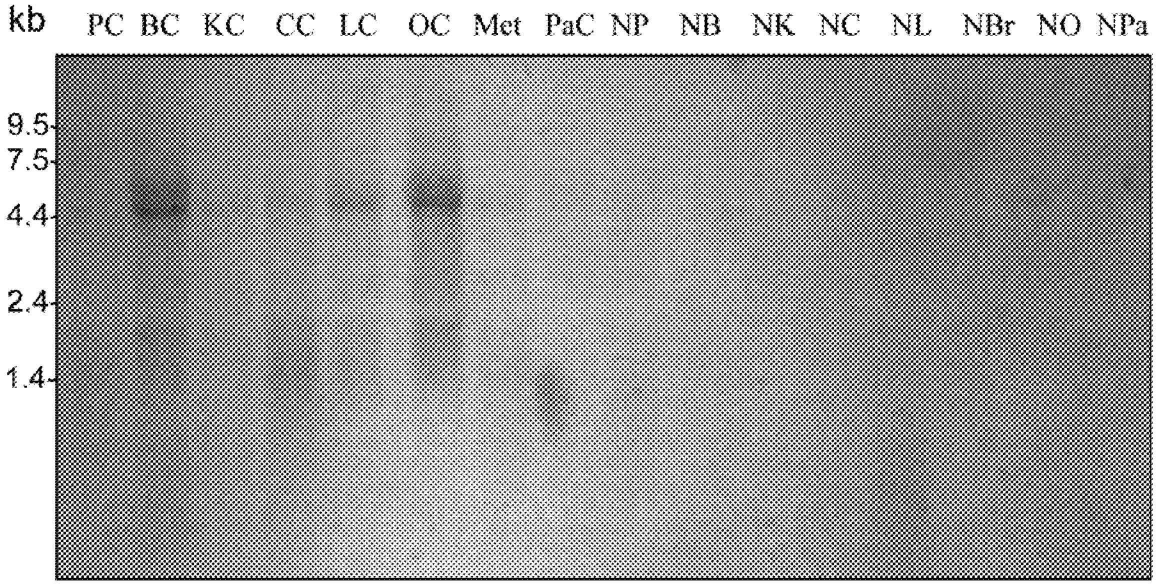

*PC = Prostate cancer pool*
*BC = Bladder cancer pool*
*KC = Kidney cancer pool*
*CC = Colon Kidney cancer pool*
*LC = Lung Kidney cancer pool*
*OC = Ovary cancer pool*
*MC = Cancer metastasis pool*
*PaC = Pancreas cancer pool*
*NP = Normal Prostate*
*NB = Normal Bladder*
*NK = Normal Kidney*
*NC = Normal Colon*
*NL = Normal Lung*
*NBr = Normal Breast*
*NO = Normal Ovary*
*NPr = Normal Pancreas*

Figure 22 Expression of 83P4B8 in Prostate Cancer Patients Specimens
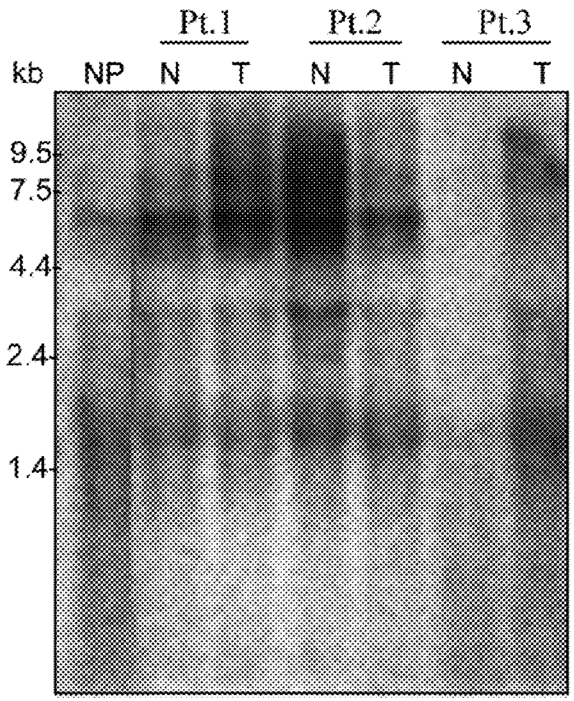
*NP = Normal prostate*
*N = Normal adjacent tissue*
*T = Tumor*
Patient 1- Gleason Score 4+5
Patient 2- Gleason Score 3+4
Patient 3- Gleason Score 4+3

Figure 23 Expression of 83P4B8 in Colon Cancer Patient Specimens
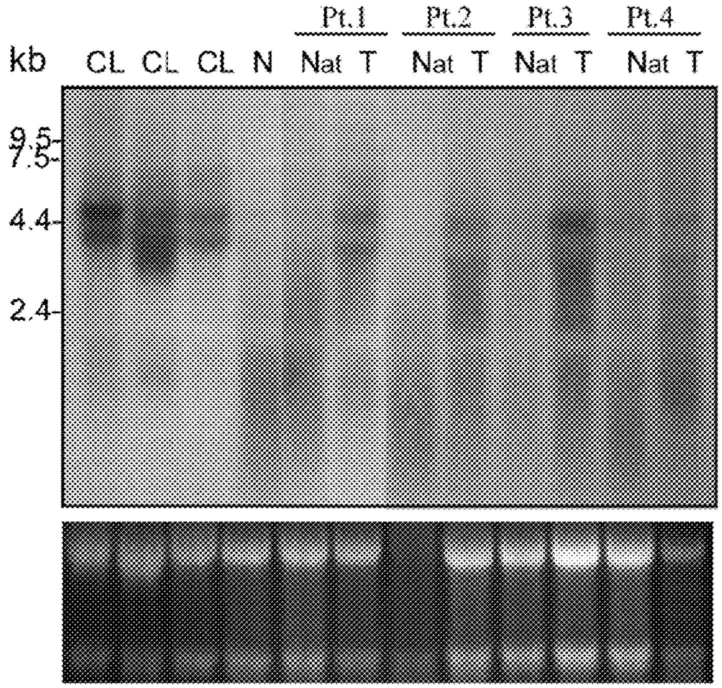
Pt.1, stage II
Pt.2, stage III
Pt.3, stage IV
Pt.4, stage IV
*N* = *Normal colon*
*Nat* = *Normal Adjacent Tissue*
*T* = *Tumor*
*CL* = *Cell lines (Colo 205, LoVo, SK-CO-1)*

Figure 24 Expression of 109P1D4 by RT-PCR
M = Marker
1. Vital pool 1
2. Vital pool 2
3. Prostate cancer pool
4. Bladder cancer pool
5. Kidney cancer pool
6. Colon cancer pool
7. Lung cancer pool
8. Ovary cancer pool
9. Breast cancer pool
10. Cancer metastasis pool
11. Pancreas cancer pool
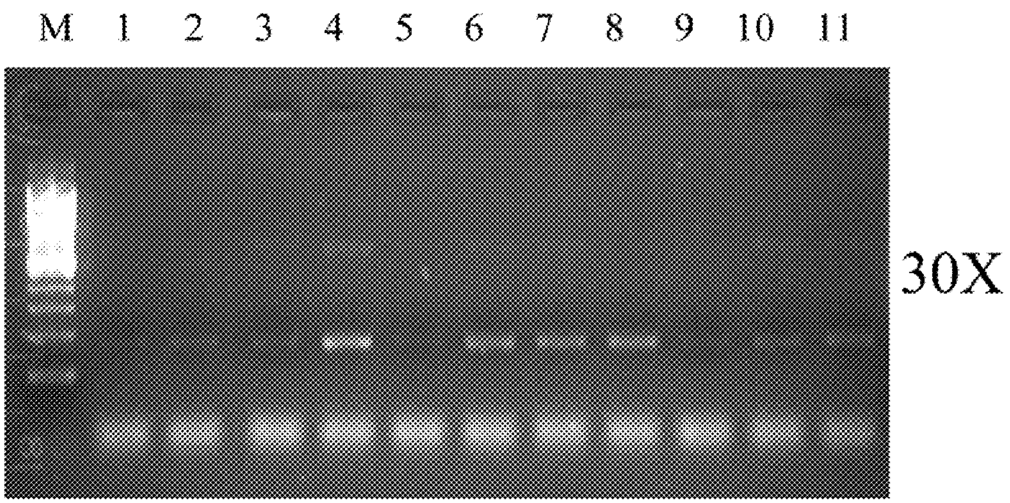

Figure 25 Expression of 109P1D4 in Normal Tissues by Northern Blot
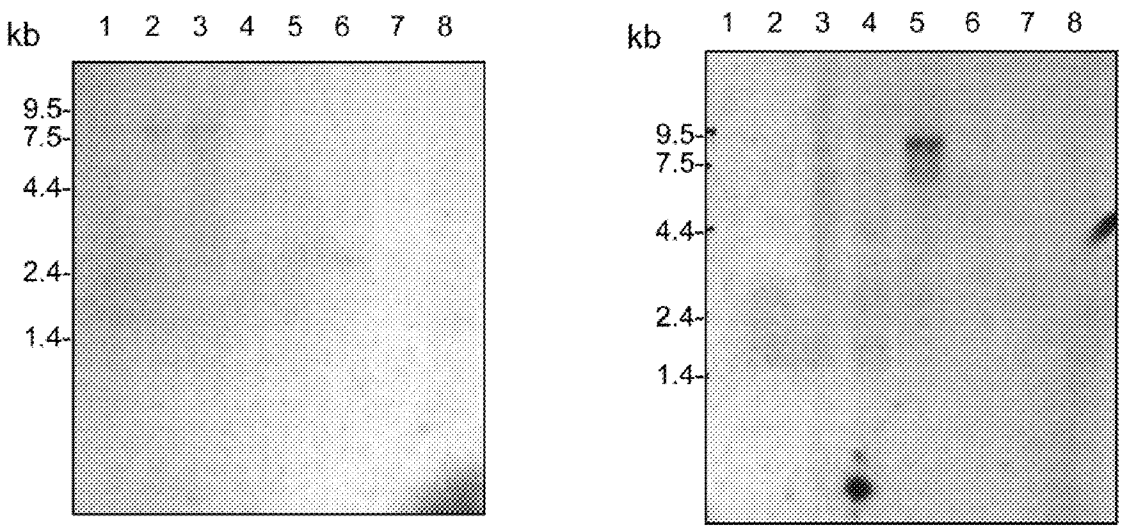
A
1. Heart
2. Brain
3. Placenta
4. Lung
5. Liver
6. Skeletal Muscle
7. Kidney
8. Pancreas
B
1. Spleen
2. Thymus
3. Prostate
4. Testis
5. Ovary
6. Small Intestine
7. Colon
8. Leukocytes

Figure 26 Expression of 109P1D4 in prostate and bone cancer cell lines
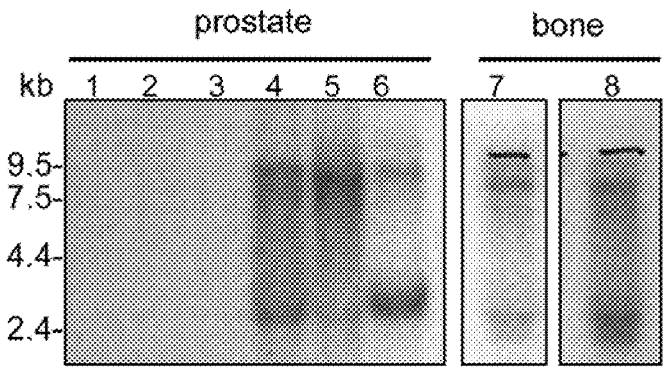
1. PrEC
2. LAPC-4 AD
3. LAPC-4 AI
4. LAPC-9 AD
5. LAPC-9 AI
6. LNCaP
7. SK-ES-1
8. RD-ES

Figure 27 Expression of 109P1D4 in Human Patient Cancer Specimens
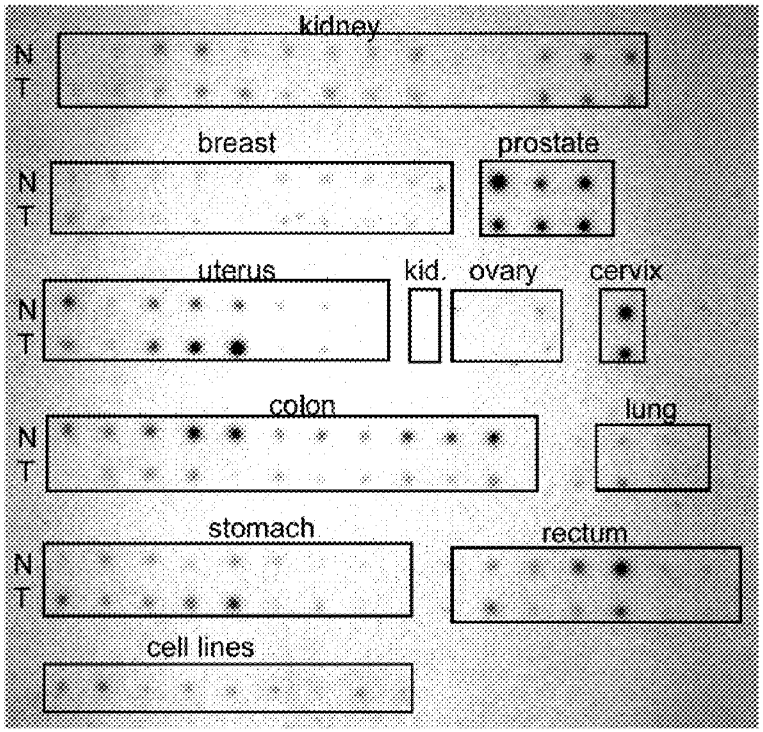
N = normal adjacent tissue RNA
T = tumor RNA
Cancer cell lines are:
(from left to right)
HeLa (cervical carcinoma)
Daudi (Burkitt's lymphoma)
K562 (CML)
HL-60 (PML)
G361 (melanoma)
A549 (lung carcinoma)
MOLT-4 (lymphoblastic leuk.)
SW480 (colorectal carcinoma)
Raji (Burkitt's lymphoma)

Figure 28 Expression of 151P1C7A by RT-PCR
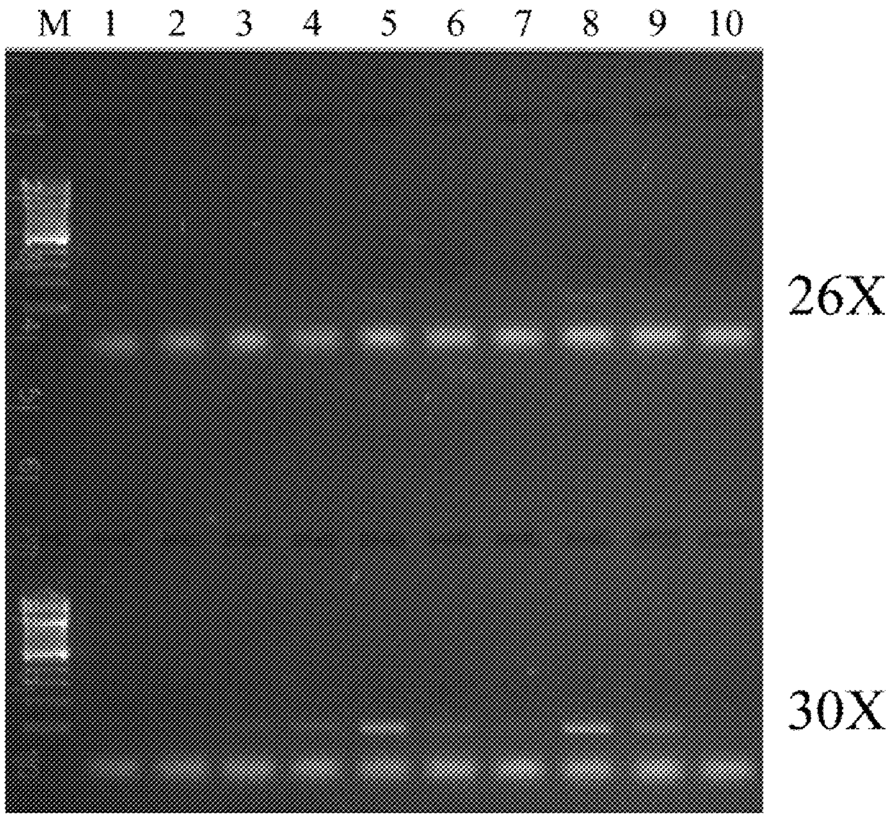
1. Vital pool 1
2. Vital pool 2
3. Xenograft pool
4. Prostate cancer pool
5. Bladder cancer pool
6. Kidney cancer pool
7. Colon cancer pool
8. Lung cancer pool
9. Cancer metastasis pool
10. H2O

Figure 29 Expression of 151P1C7A in Normal Tissues
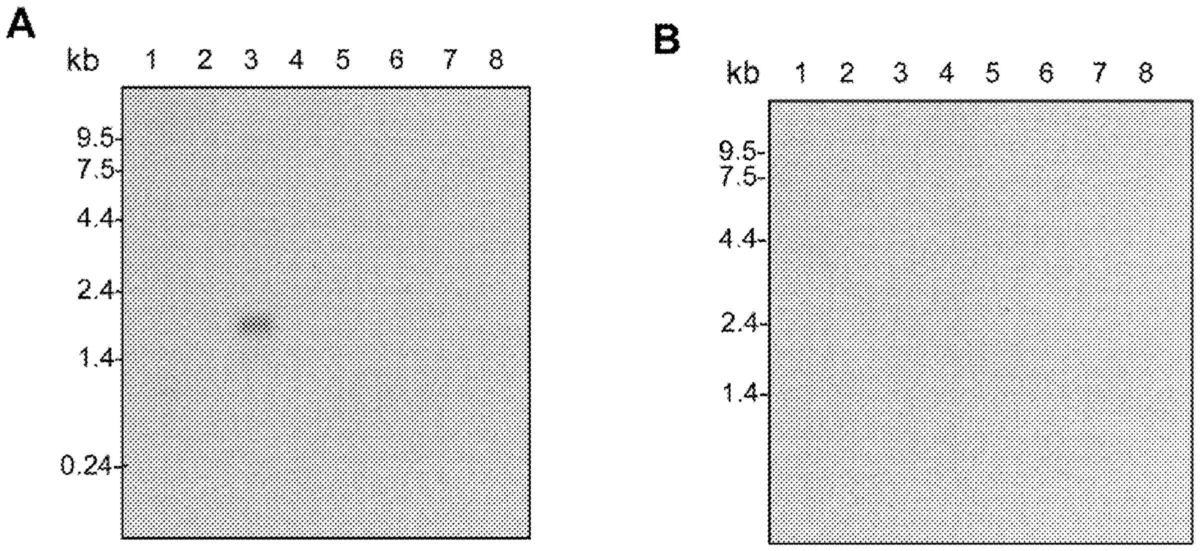
A:
1. Heart
2. Brain
3. Placenta
4. Lung
5. Liver
6. Skeletal Muscle
7. Kidney
8. Pancreas
B:
1. Spleen
2. Thymus
3. Prostate
4. Testis
5. Ovary
6. Small Intestine
7. Colon
8. Leukocytes

Figure 30 Expression of 151P1C7A in Bladder Cancer Patient Specimens
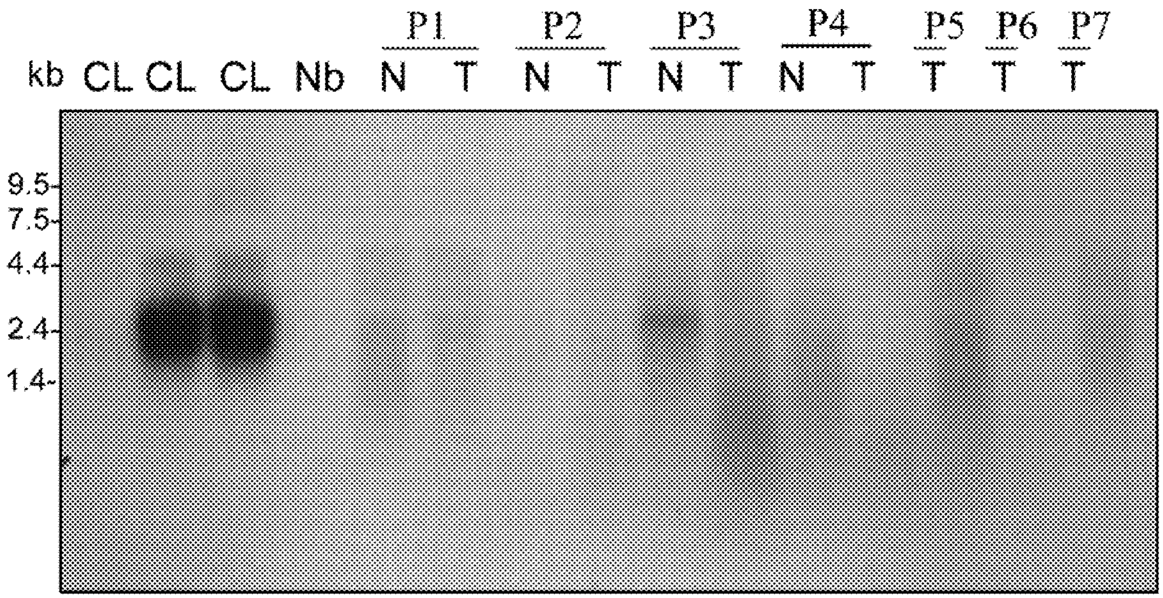
P1 - Transitional, grade 4
P2 - Squamous inv.
P3 - Transitional inv, grade 3/3
P4 - Transitional, grade 3
P5 - Papillary non -inv, grade 1/3
P6 - Papillary, grade 3/3
P7 - Transitional, grade 3/2
*Cl = cell lines listed in order: UM-UC-3, J82, SCABER*
*P = Patient*
*Nb = Normal Bladder*
*N = Normal adjacent tissue*
*T = Tumor*

Figure 31 Expression of 151P1C7A in Prostate Cancer Patient Specimens
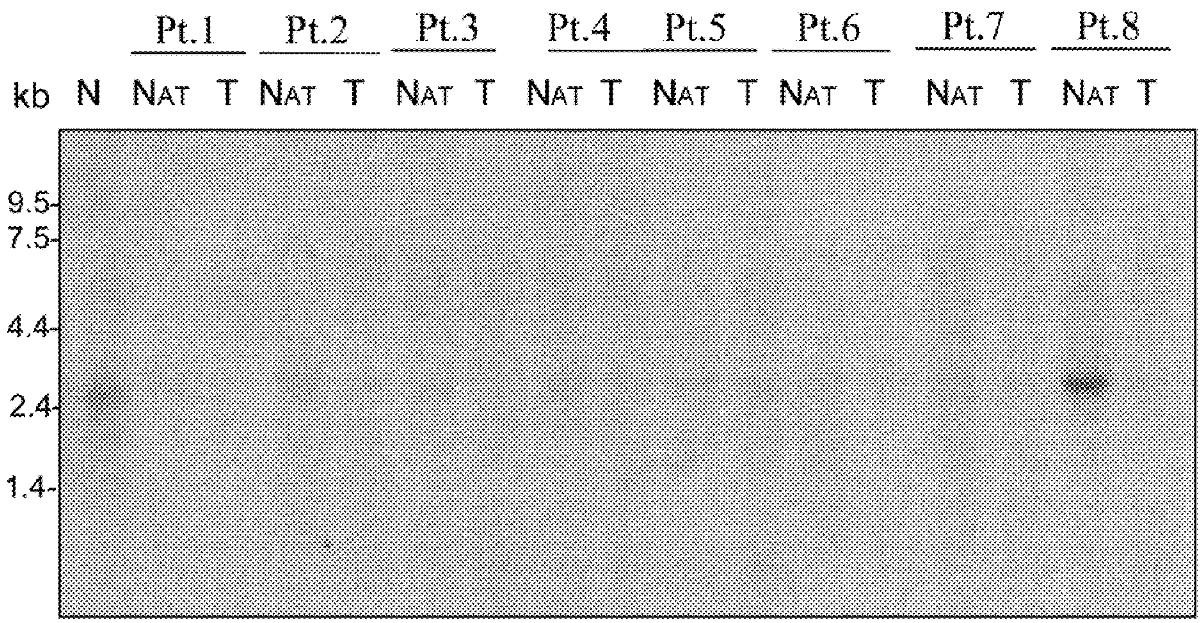
Pt.1, Gleason score 6
Pt.2, Gleason score 6
Pt.3, Gleason score 6
Pt.4, Gleason score 6
Pt.5, Gleason score 7
Pt.6, Gleason score 9
Pt.6, Gleason score 9
Pt.7, Gleason score 9
Pt.8, Gleason score 9
*N* = *Normal Prostate*
*$N_{AT}$* = *Normal adjacent tumor*
*T* = *Tumor*

Figure 32 Expression of 151P4E11 by RT-PCR
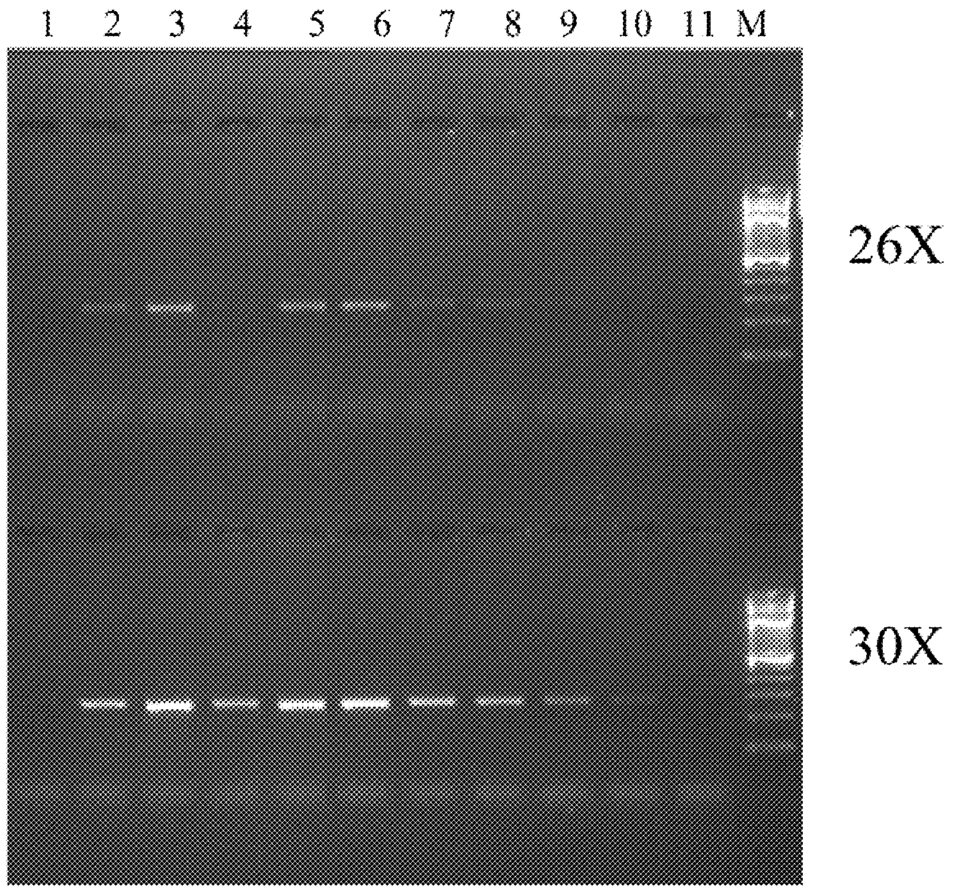
1. Vital pool 1
2. Vital pool 2
3. Xenograft pool
4. Prostate cancer pool
5. Bladder cancer pool
6. Colon cancer pool
7. Lung cancer pool
8. Ovary cancer pool
9. Breast cancer pool
10. Cancer metastasis pool
11. H2O
M = Marker Figure 33 Expression of 151P4E11 in Normal Tissues and in Prostate Cancer Xenografts
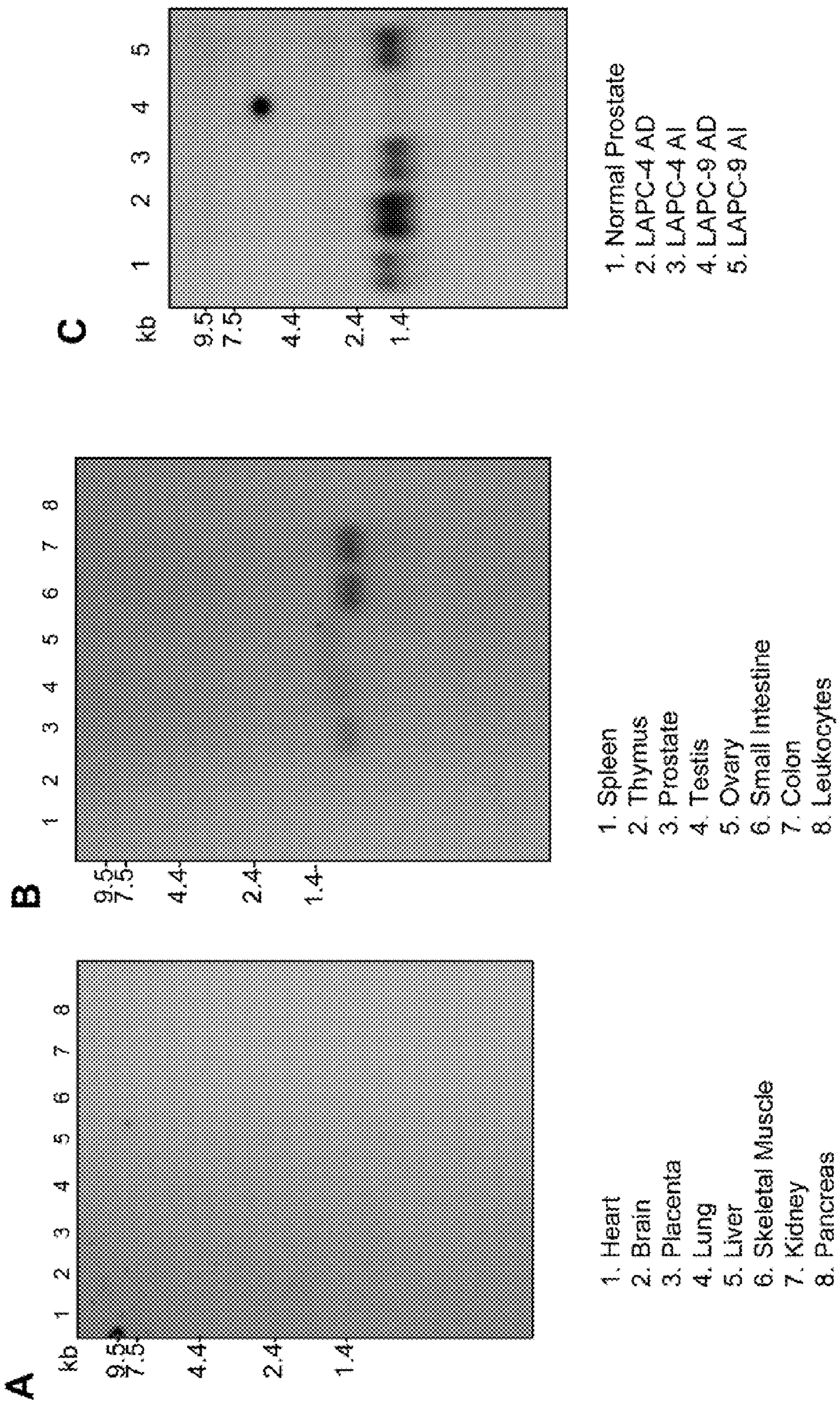

Figure 34 Expression of 154P2A8 by RT-PCR
M = Marker
1. Vital pool 1
2. Vital pool 2
3. Prostate cancer pool
4. Bladder cancer pool
5. Kidney cancer pool
6. Colon cancer pool
7. Lung cancer pool
8. Breast cancer pool
9. Cancer metastasis pool
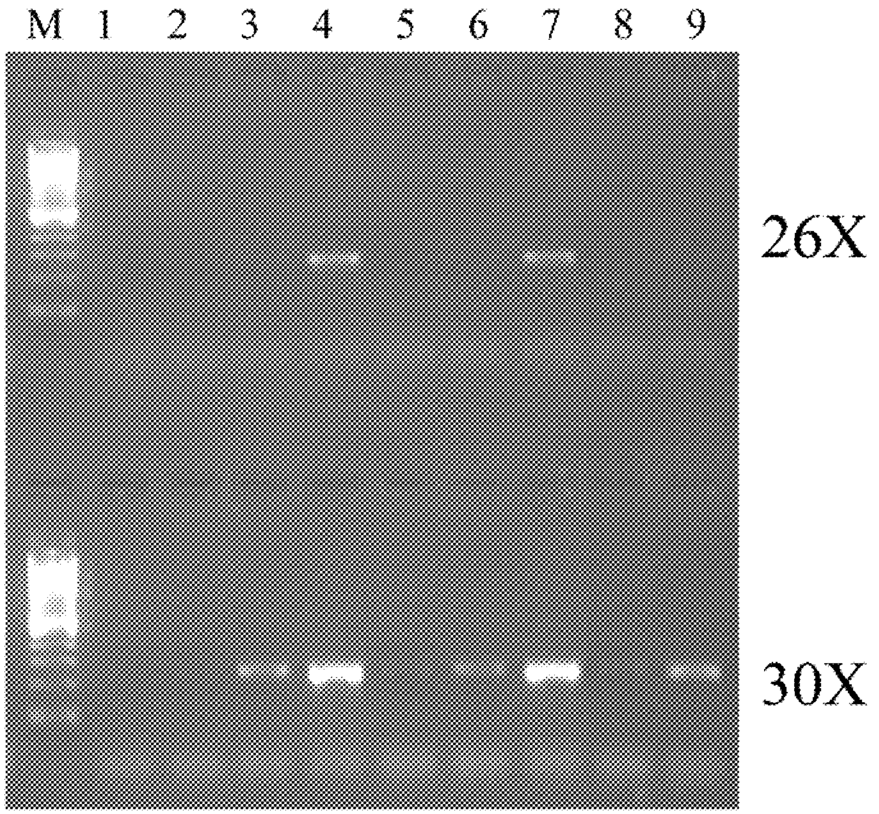

Figure 35 Expression of 156P1D4 by RT-PCR
1. Vital pool 1
2. Vital pool 2
3. Xenograft pool
4. Prostate cancer pool
5. Bladder cancer pool
6. Kidney cancer pool
7. Colon cancer pool
8. Lung cancer pool
9. Ovary cancer pool
10. Breast cancer pool
11. Cancer metastasis pool
12. H2O
M = Marker
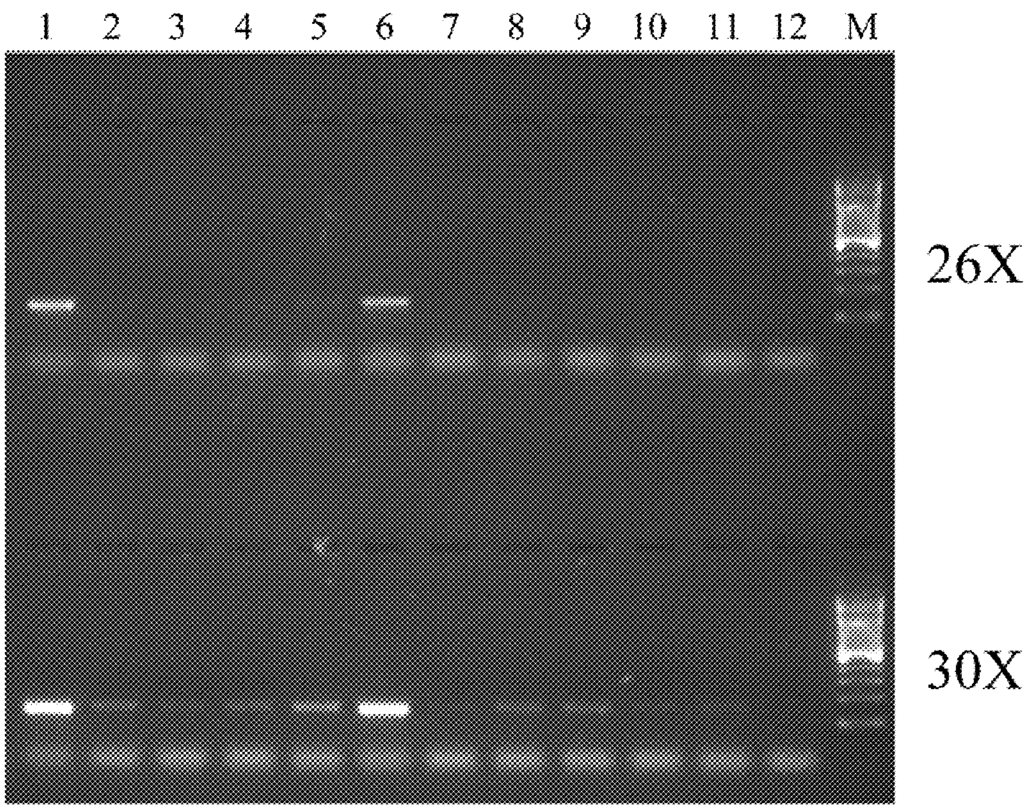

Figure 36 Expression of 156P1D4 in Normal Tissues
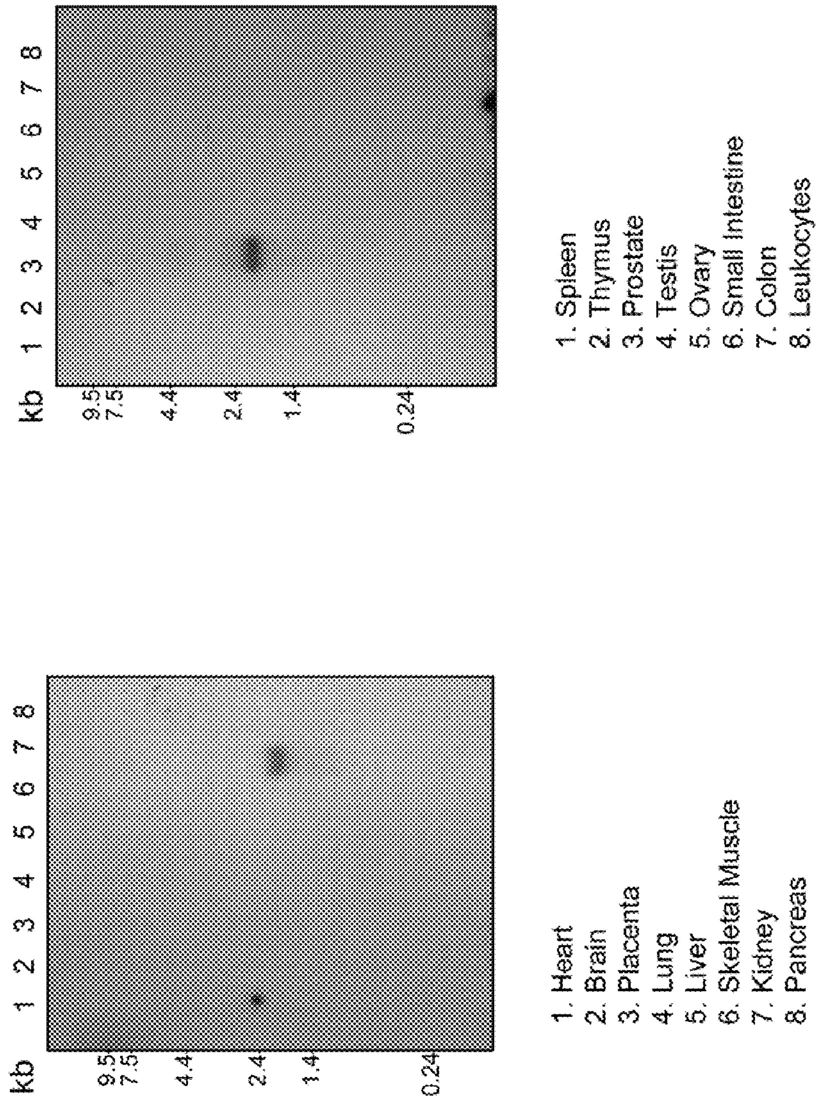

Figure 37 Expression of 156P1D4 in Kidney Cancer Patient Specimens

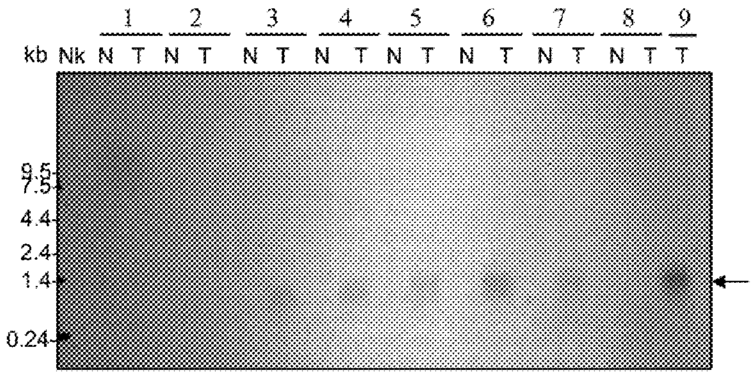

Patient 1 - papillary cell, grade 1
Patient 2 - papillary adenocarc, nuclear, grade 3
Patient 3 - clear cell, Fuhrman grade 2 of 4
Patient 4 - clear cell, grade III
Patient 5 - clear cell, grade II/IV
Patient 6 - clear cell, grade 3
Patient 7 - clear cell, grade III/IV
Patient 8 - chromophobe cell type, grade IV
Patient 9 - met to chest wall

*NK = Normal kidney*
*N = Normal adjacent tissue*
*T = Tumor*

Figure 38 Expression of 156P5C12 by RT-PCR
M = Marker
1. Vital pool 1
2. Vital pool 2
3. Xenograft pool
4. Prostate cancer pool
5. Bladder cancer pool
6. Kidney cancer pool
7. Colon cancer pool
8. Lung cancer pool
9. Ovary cancer pool
10. Breast cancer pool
11. Cancer metastasis pool
12. H2O
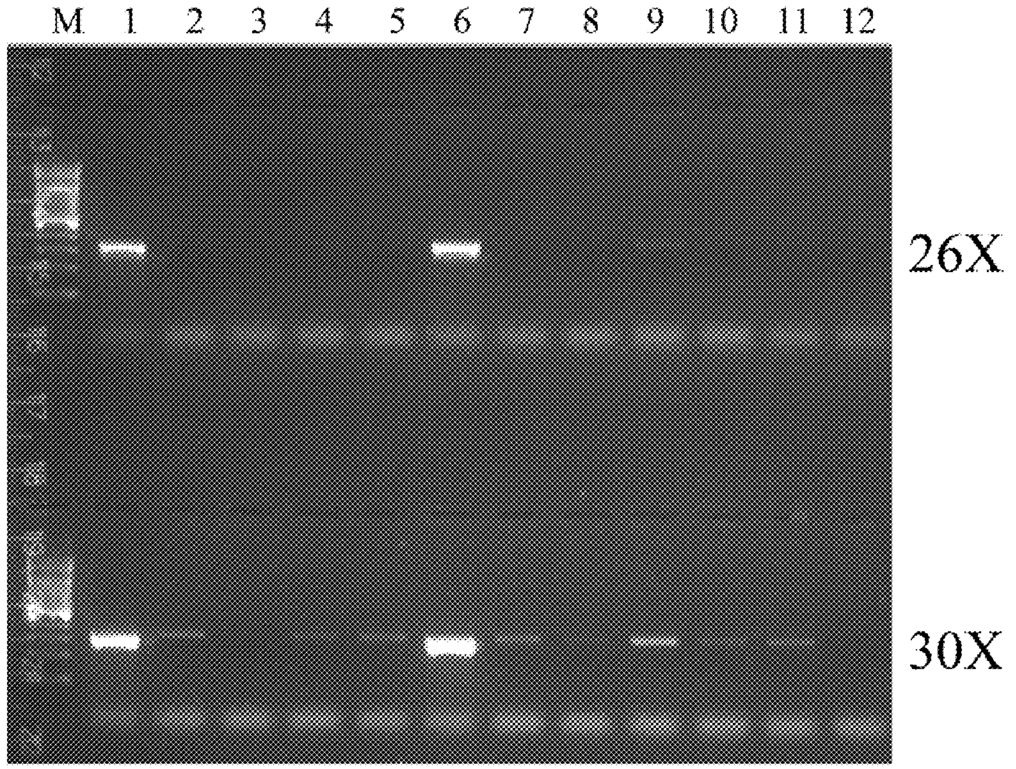

Figure 39 Expression of 156P5C12 in Normal Tissues
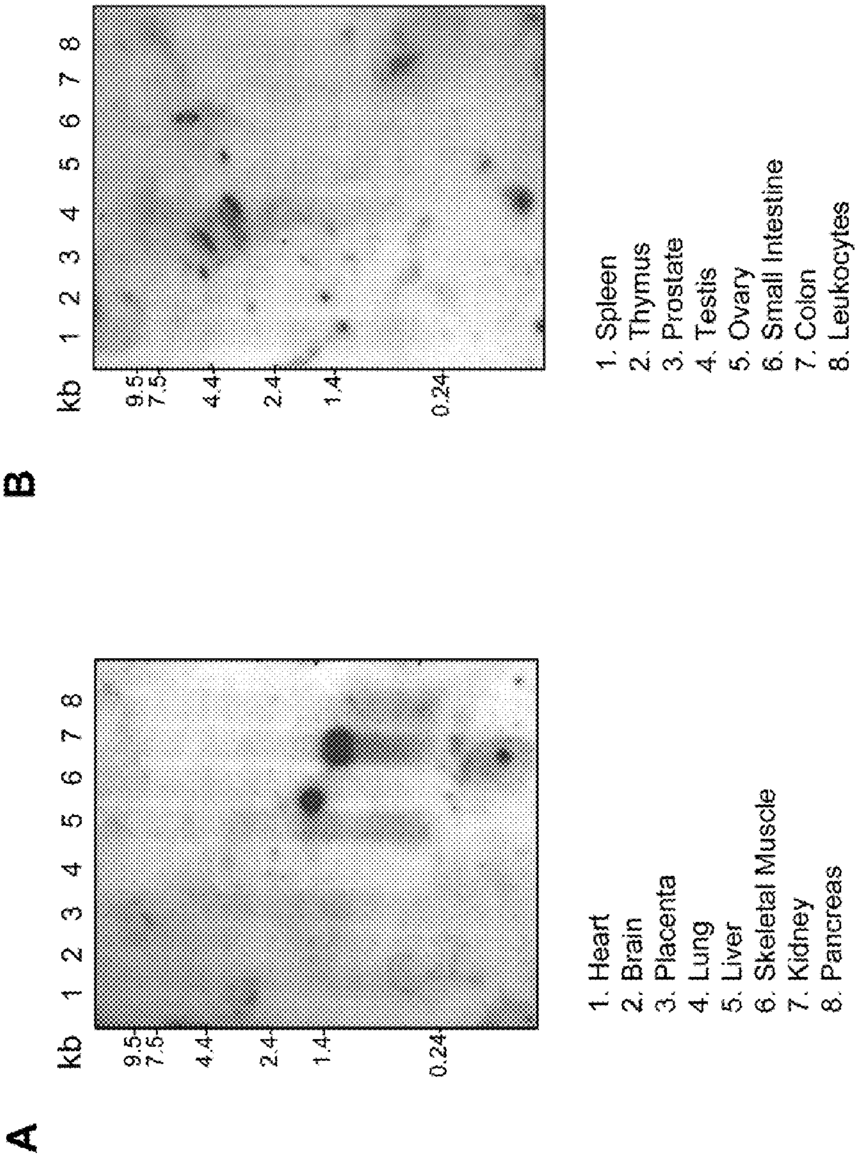

Figure 40 Expression of 156P5C12 in Kidney Cancer Patient Specimens
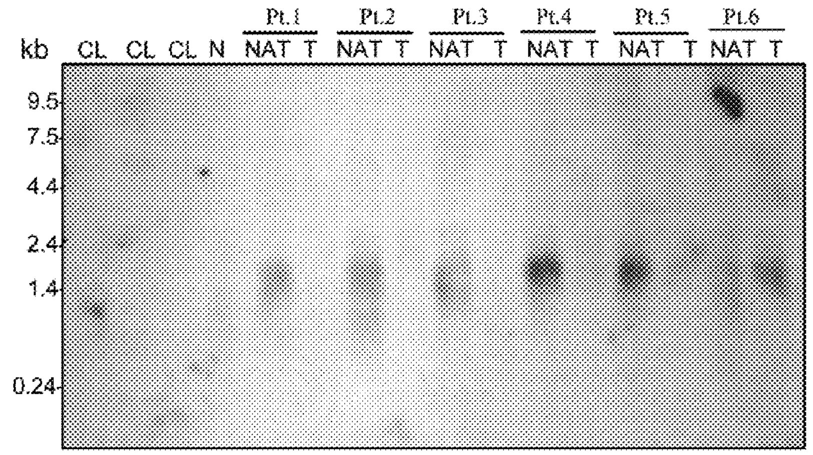
*CL = cell lines listed in order: 769-P, A498, SW839*
*N = Normal kidney*
*NAT = Normal adjacent tumor*
*T = Tumor*
Pt.1, Papillary carcinoma, stage I
Pt.2, Invasive papillary carcinoma
Pt.3, Clear cell type grade 1/3, focally 2/3
Pt.4, Clear cell type, stage III
Pt.5, Clear cell type, stage III
Pt.6, Clear cell type, stage III

Figure 41 Expression of 159P2B5 by RT-PCR
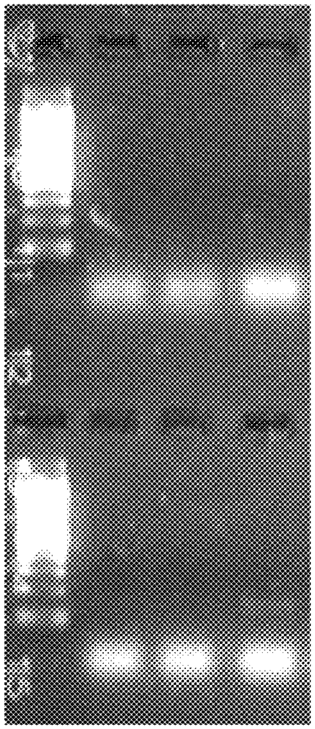
M = Marker
1. Vital pool 1
2. Vital pool 2
3. Bladder cancer pool Figure 42 Expression of 159P2B5 in Normal Tissues
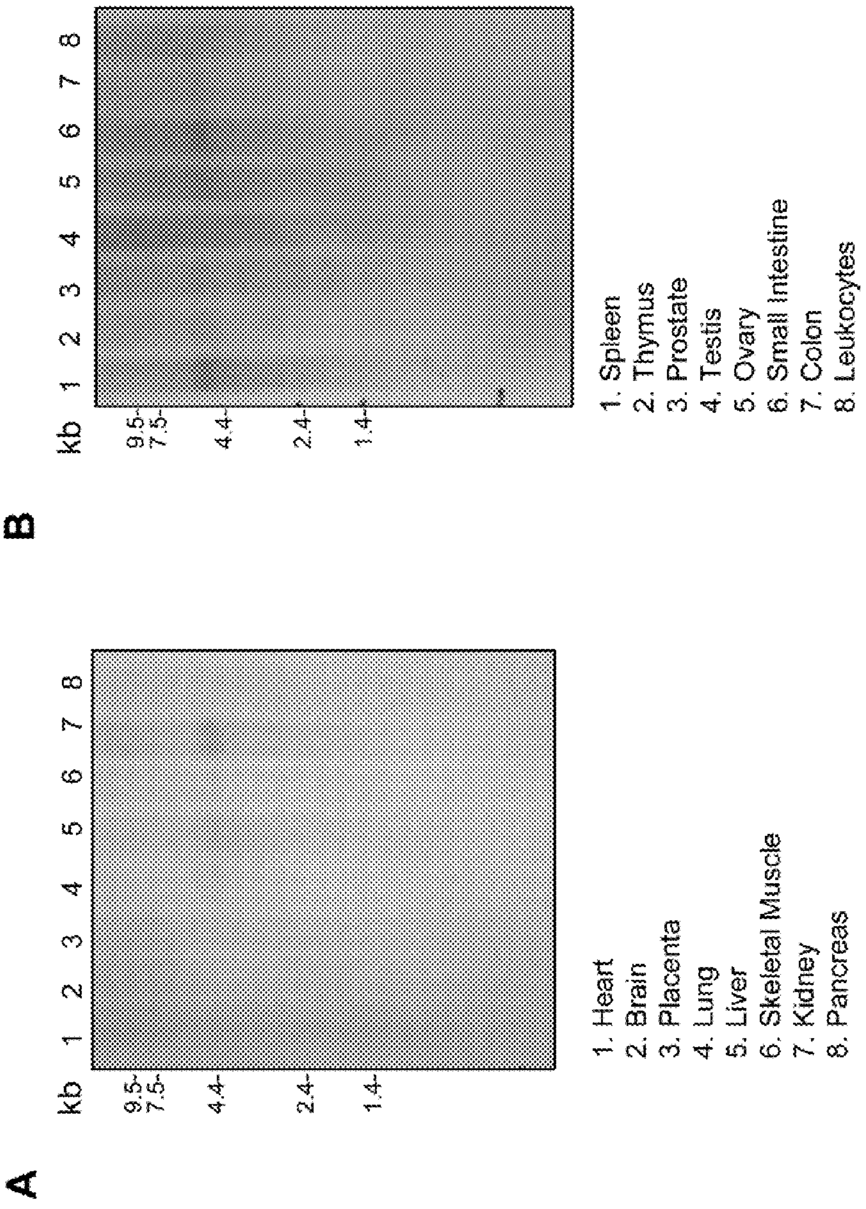

Figure 43 Expression of 159P2B5 in Bladder Cancer Patient Specimens
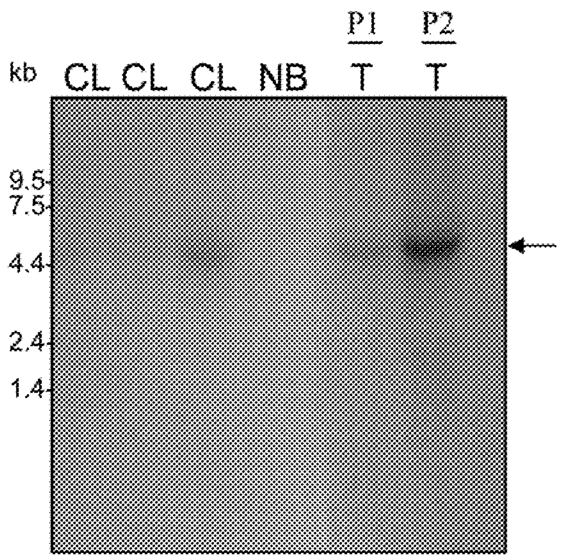
P1 - Papillary, grade 3/3
P2 - Transitional, grade 3/2
*Cl = cell lines listed in order: UM-UC-3, J82, SCABER*
*P = Patient*
*NB = Normal Bladder*
*T = Tumor*

Figure 44 Expression of 161P2B7A by RT-PCR
M = Marker
1. Vital pool 1
2. Vital pool 2
3. Prostate metastasis to LN
4. Prostate cancer pool
5. Bladder cancer pool
6. Kidney cancer pool
7. Colon cancer pool
8. Lung cancer pool
9. Ovary cancer pool
10. Breast cancer pool
11. Cancer metastasis pool
12. Pancreas cancer pool
M 1 2 3 4 5 6 7 8 9 10 11 12
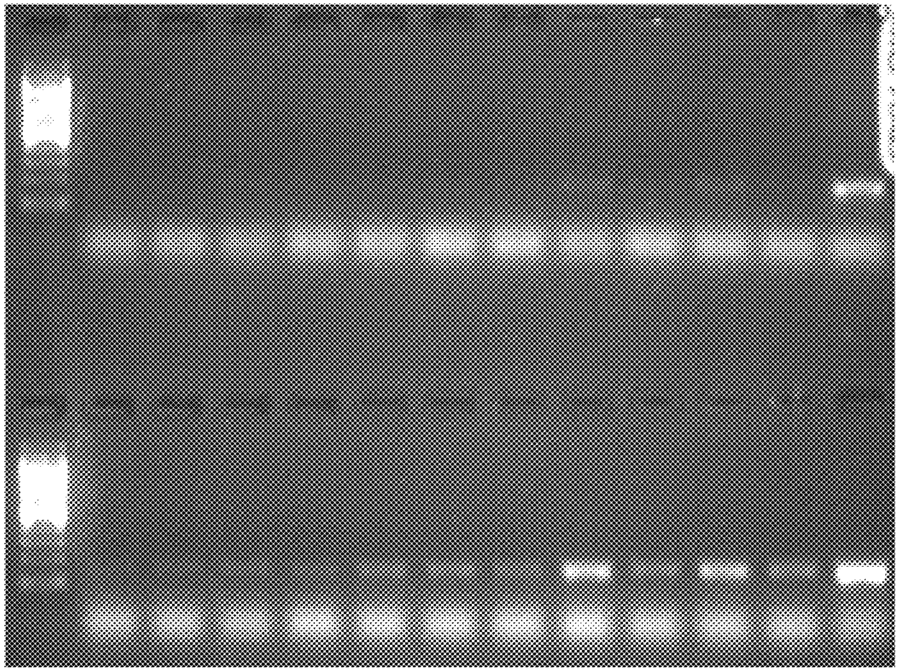
26X
30X

Figure 45 Expression of 161P2B7A in Normal Tissues
A
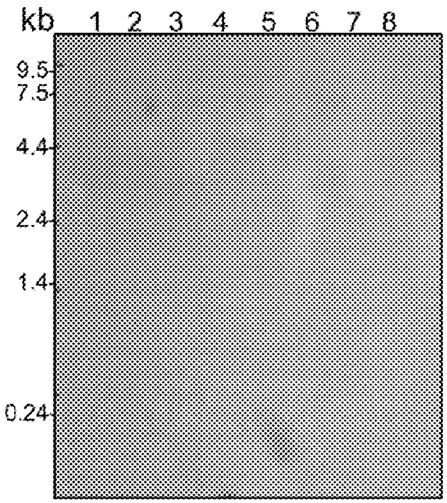
1. Heart
2. Brain
3. Placenta
4. Lung
5. Liver
6. Skeletal Muscle
7. Kidney
8. Pancreas
B
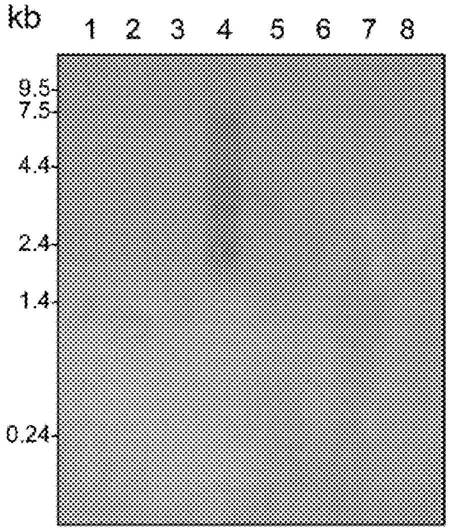
1. Spleen
2. Thymus
3. Prostate
4. Testis
5. Ovary
6. Small Intestine
7. Colon
8. Leukocytes

Figure 46 Expression of 161P2B7A in Multiple Normal Tissues

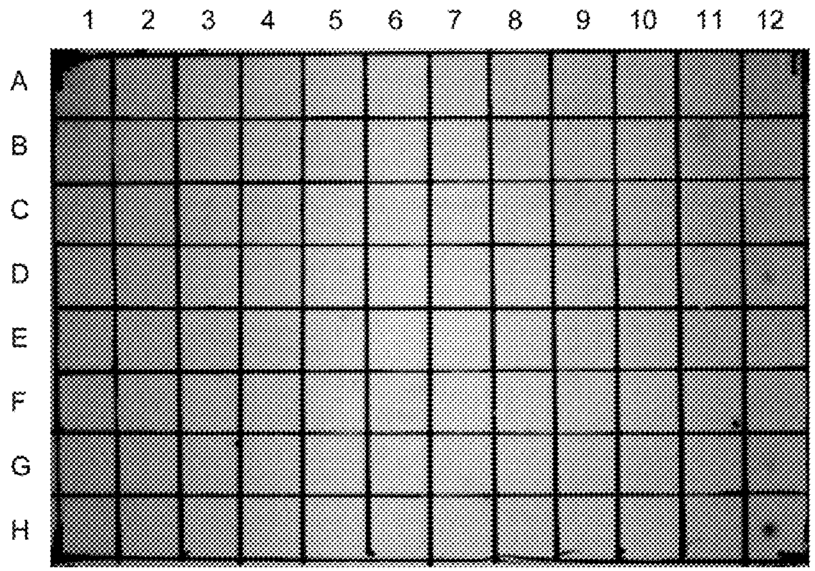

A1 whole brain
A2 cerebellum, left
A3 substantia nigra
A4 heart
A5 esophagus
A6 colon, transverse
A7 kidney
A8 lung
A9 liver
A10 HL60, leukemia
A11fetal brain H1 pons
H2 putamen
H3 -
H4 apex of the heart
H5 colon, ascending
H6 -
H7 trachea
H8 -
H9 -
H10 A549, lung cancer
H11 --
H12 Genomic DNA B1 cerebral cortex
B2 cerebellum, right
B3 accumbens nucleus
B4 aorta
B5 stomach
B6 colon, descending
B7 skeletal muscle
B8 placenta
B9 pancreas
B10 HeLa, S3
B11fetal heart C1 frontal lobe
C2 corpus callosum
C3 thalamus
C4 atrium, left
C5 duodenum
C6 rectum
C7 spleen
C8 bladder
C9 adrenal gland
C10 K562, leukemia
C11 fetal kidney D1 parietal lobe
D2 amygdala
D3 pituitary gland
D4 atrium, right
D5 jejunum
D6 -
D7 thymus
D8 uterus
D9 thyroid gland
D10 MOLT-4
D11 fetal liver E1 occipital lobe
E2 caudate nucleus
E3 spinal cord
E4 ventricle, left
E5 ileum
E6 -
E7 leukocytes
E8 prostate
E9 salivary gland
E10 RAJI, lymphoma
E11 fetal spleen F1 temporal lobe
F2 hippocampus
F3 -
F4 ventricle, right
F5 ilocecum
F6 -
F7 lymph node
F8 testis
F9 mammary gland
F10 DAUDI, lymphoma
F11 fetal thymus
F12 Genomic DNA G1 paracentral gyrus
G2 medulla oblongata
G3 -
G4 interventricular septum
G5 appendix
G6 -
G7 bone marrow
G8 ovary
G9 -
G10 SW480, colon cancer
G11 fetal lung
G12 Genomic DNA

Figure 47 Expression of 161P2B7A in Kidney Cancer Patient Specimens

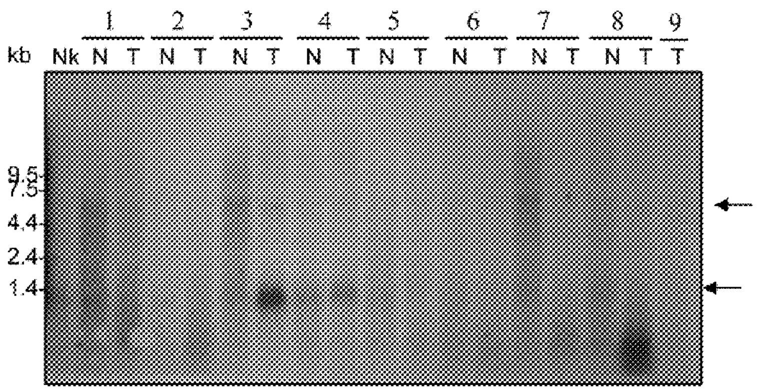

Patient 1- papillary cell, grade 1
Patient 2 - papillary adenocarc, nuclear, grade 3
Patient 3 - clear cell, Fuhrman grade 2 of 4
Patient 4 - clear cell, grade III
Patient 5 - clear cell, grade II/IV
Patient 6 - clear cell, grade 3
Patient 7 - clear cell, grade III/IV
Patient 8 - chromophobe cell type, grade IV
Patient 9 - met to chest wall

*Nk = Normal kidney*
*N = Normal adjacent tissue*
*T = Tumor*

Figure 48 Expression of 161P2B7A in Lung Cancer Patient Specimens
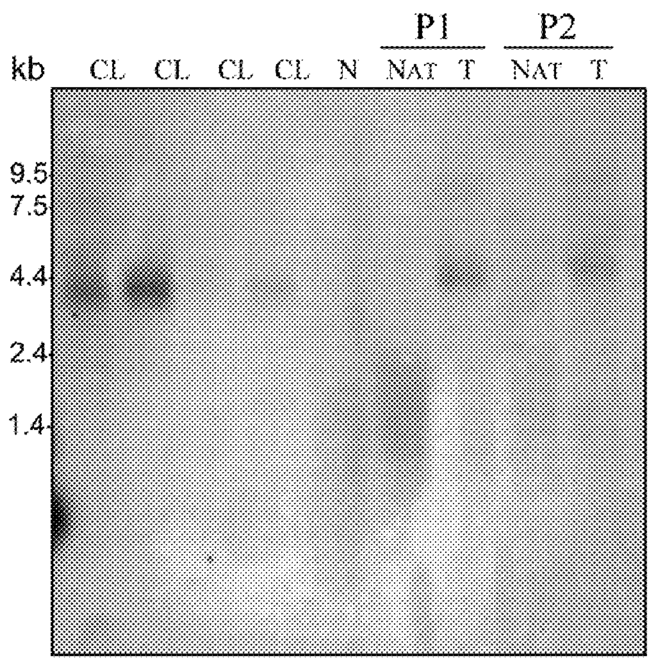
P1 - Squamous, stage IB
P2 - Squamous, stage IIIA
*CL = cell lines (listed in order): CALU-1, A427, NCI-H82, NCI-H146*
*P = Patient*
*N = Normal Lung*
*NAT = Normal adjacent tissue*
*T = Tumor*

Figure 49 Expression of 161P2B7A in Pancreas and Ovary Cancer Patient Specimens
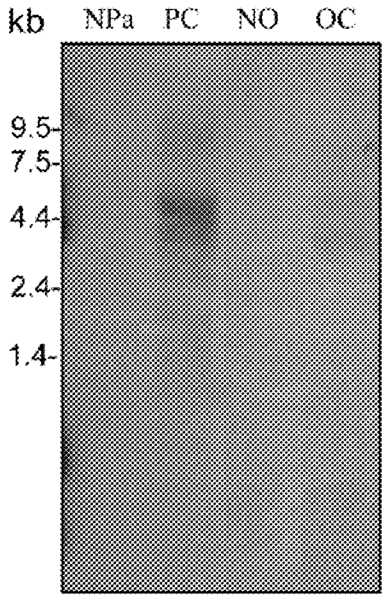
*NPa = Normal pancreas*
*PC = Pancreas cancer patient specimen*
*NO = Normal ovary*
*OC = Ovary cancer patient specimen*

Figure 50 Expression of 179P3G7 by RT-PCR
M = Marker
1. Vital pool 1
2. Vital pool 2
3. Bladder cancer pool
4. Kidney cancer pool
5. Lung cancer pool
6. Breast cancer pool
7. Cancer metastasis pool
8. Pancreas cancer pool
9. Prostate cancer metastasis to LN
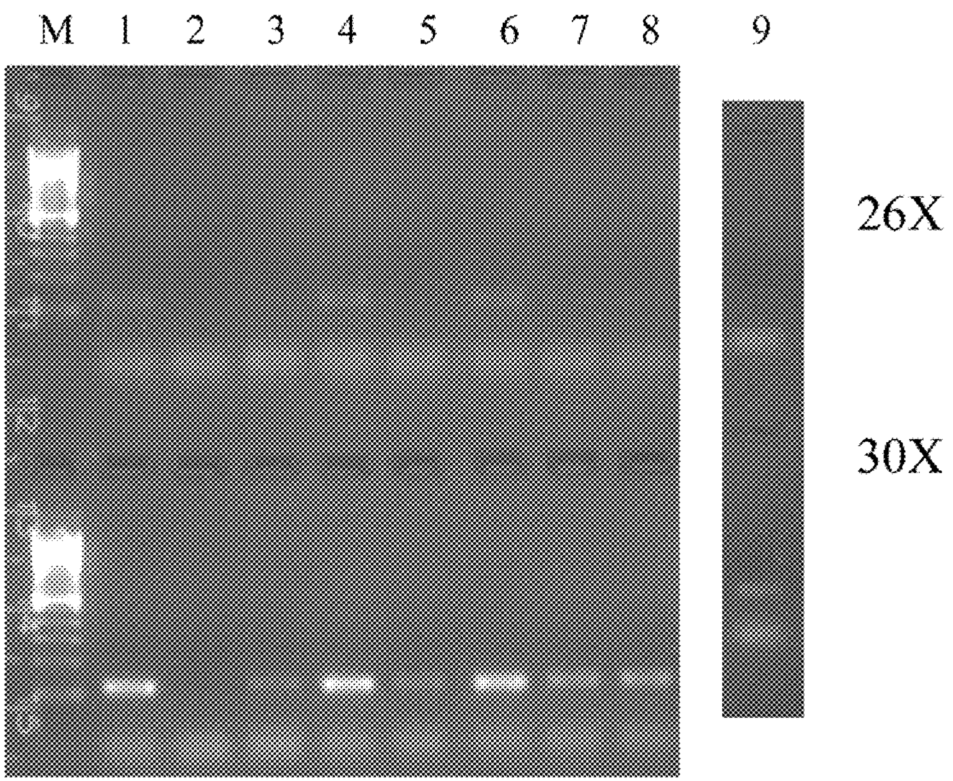

Figure 51 Expression of 179P3G7 in Normal Tissues
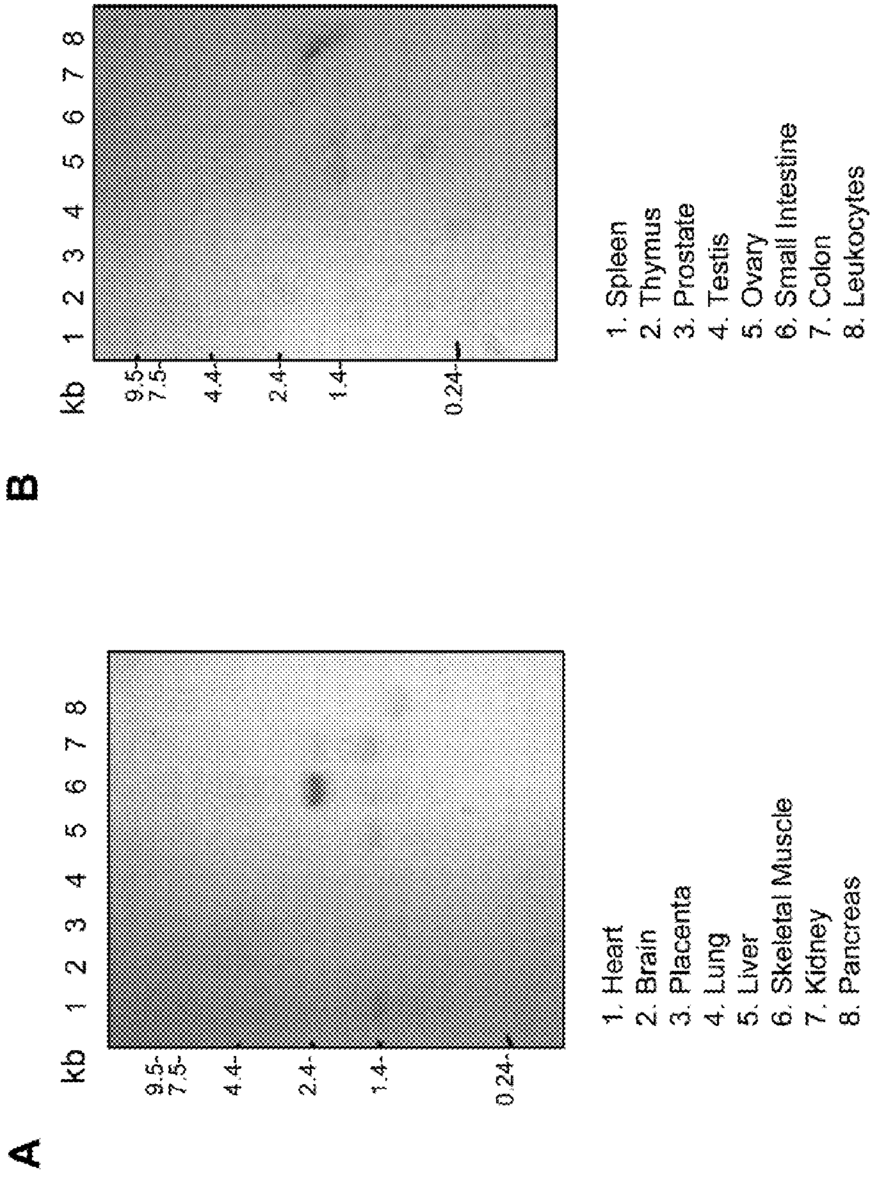

Figure 52 Expression of 179P3G7 in Kidney Cancer Patient Specimens
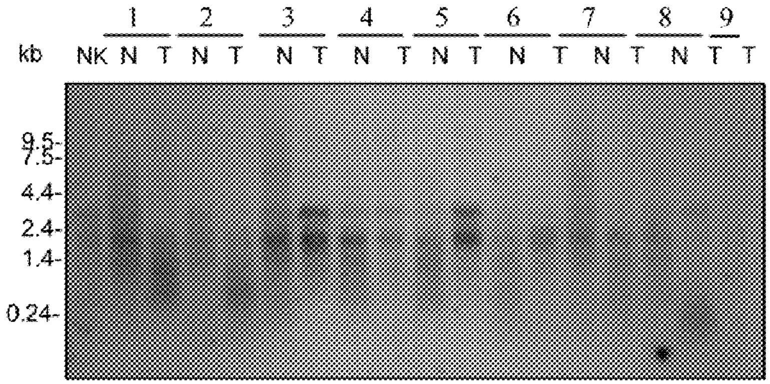
Patient 1- papillary cell, grade 1
Patient 2 - papillary adenocarc, nuclear, grade 3
Patient 3 - clear cell, Fuhrman grade 2 of 4
Patient 4 - clear cell, grade III
Patient 5 - clear cell, grade II/IV
Patient 6 - clear cell, grade 3
Patient 7 - clear cell, grade III/IV
Patient 8 - chromophobe cell type, grade IV
Patient 9 - met to chest wall

Figure 53 Expression of 184P3C10B by RT-PCR
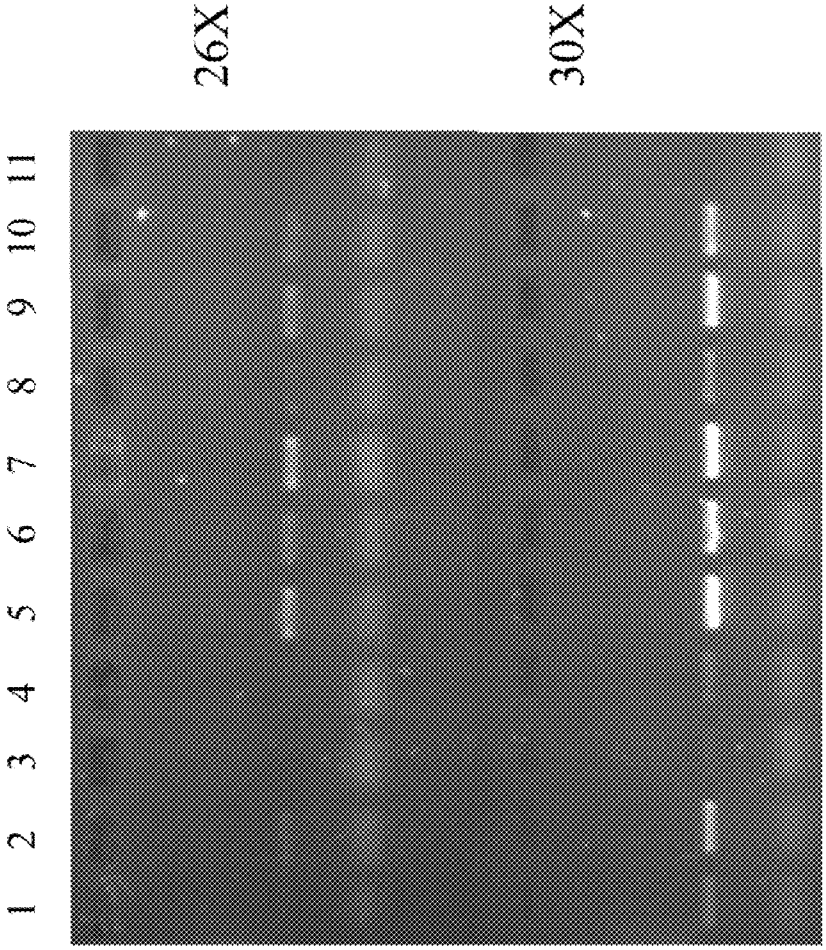
1. Vital pool 1
2. Vital pool 2
3. Xenograft pool
4. Prostate cancer pool
5. Bladder cancer pool
6. Kidney cancer pool
7. Colon cancer pool
8. Lung cancer pool
9. Ovary cancer pool
10. Cancer metastasis pool
11. H2O

Figure 54 Expression of 184P3C10B in Normal Tissues
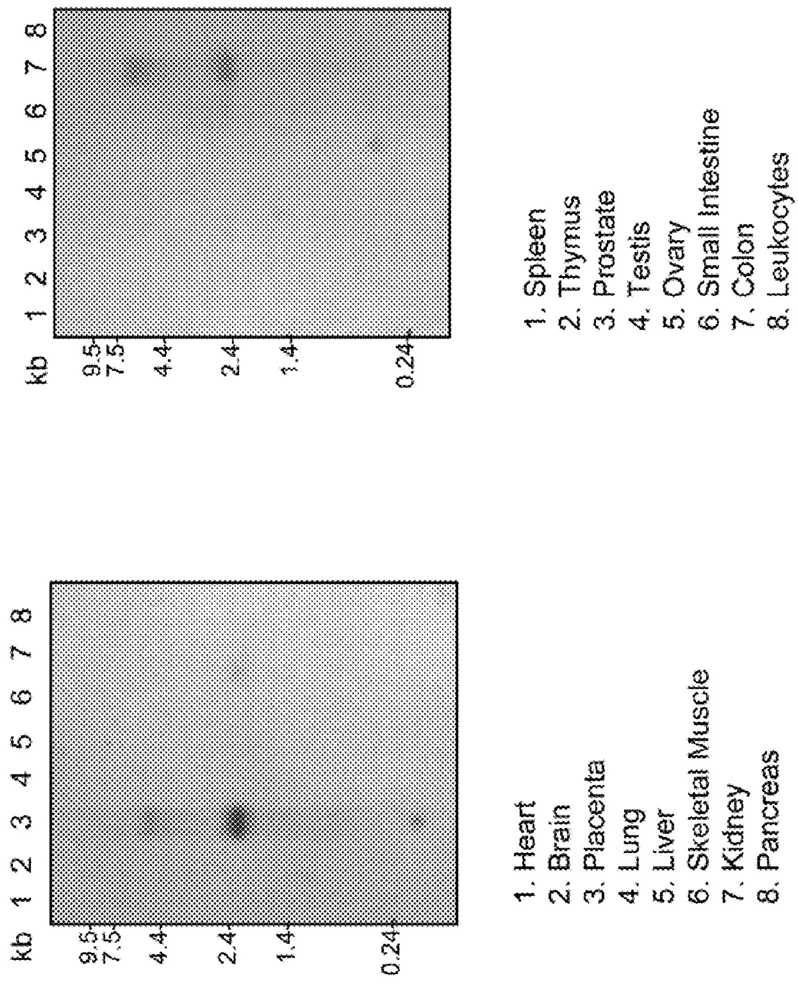

Figure 55 Expression of 184P3C10B in Bladder Cancer Specimens

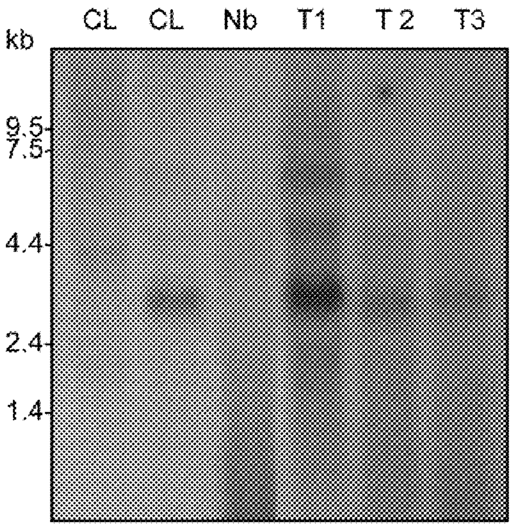

T1 - Invasive, papillary transitional carcinoma, grade 2
T2 - Invasive transitional, grade 3
T3 - Invasive, moderately differentiated transitional carcinoma, grade 3

*CL = Cell lines (from left to right): UM-UC-3, SCaBER*
*Nb = Normal Bladder*

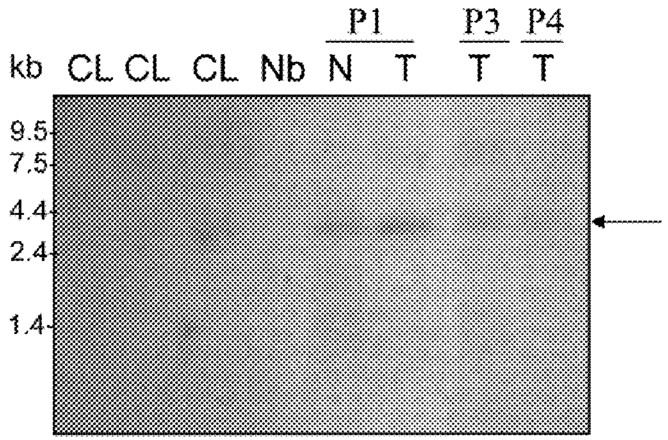

P1 - Transitional, grade 4
P2 - Papillary non -inv, grade 1/3
P3 - Papillary, grade 3/3
P4 - Transitional, grade 3/2

*CL = cell lines listed in order: UM-UC-3, J82, SCABER*
*P = Patient*
*Nb = Normal Bladder*
*N = Normal adjacent tissues*
*T = Tumor*

Figure 56 Expression of 184P3G10 by RT-PCR
1. Vital pool 1
2. Vital pool 2
3. Xenograft pool
4. Bladder cancer pool
5. Kidney cancer pool
6. Colon cancer pool
7. Lung cancer pool
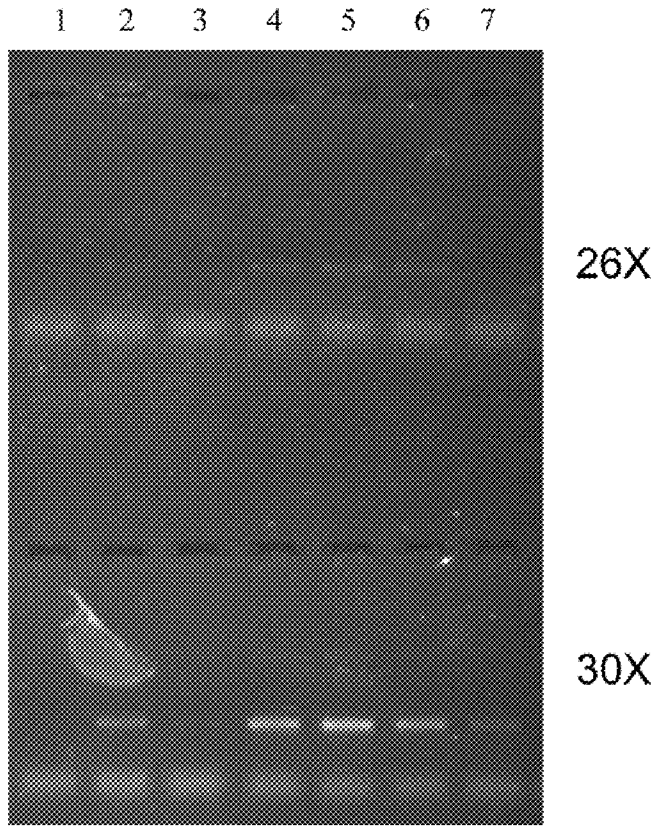

Figure 57 Expression of 184P3G10 in Normal Tissues
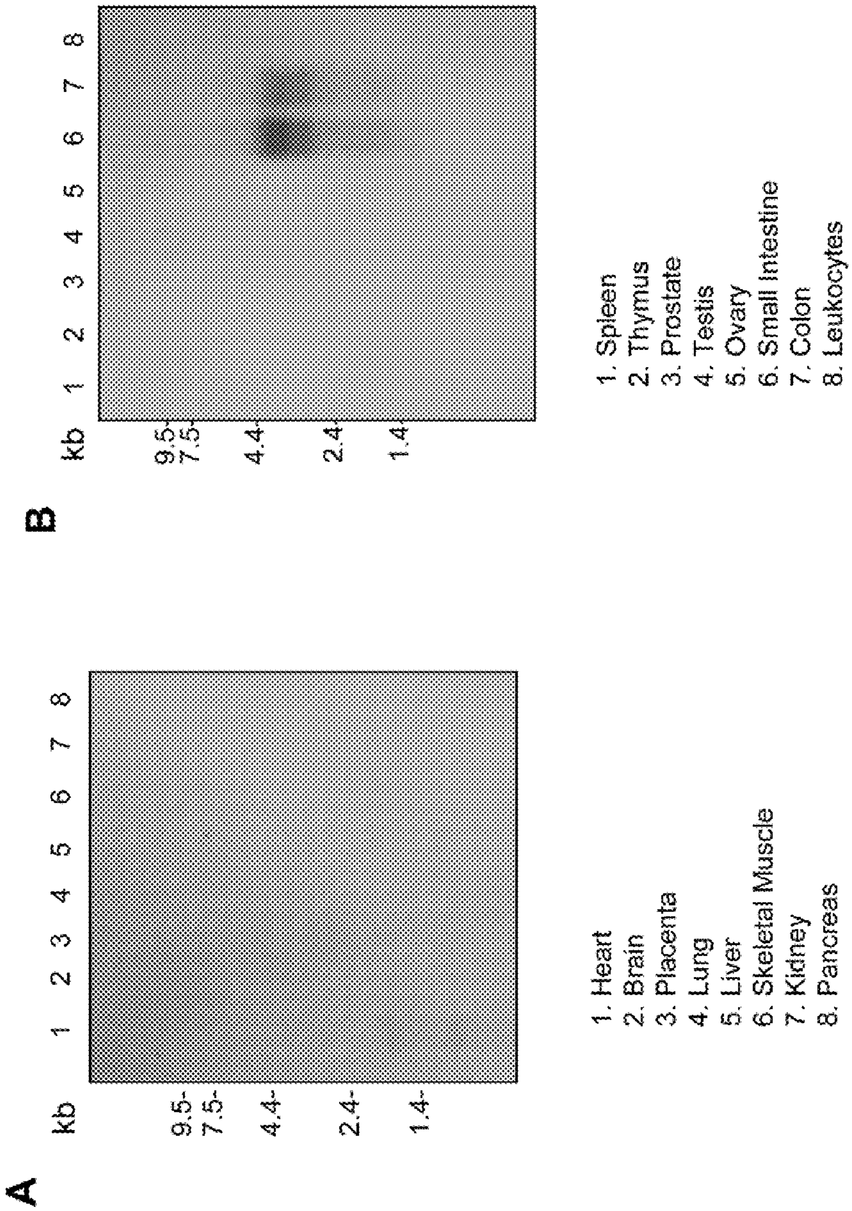

Figure 58 Expression of 184P3G10 in Human Patient Cancer Specimens and in Normal Tissues
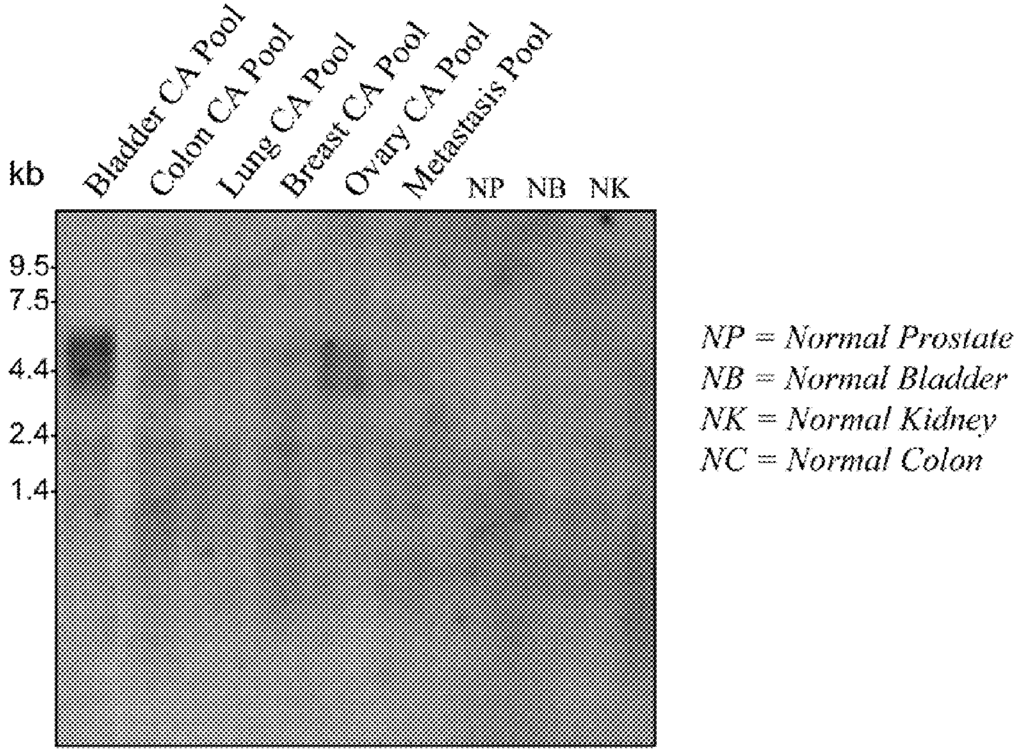

Figure 59 Expression of 184P3G10 in Bladder Cancer Patient Specimens

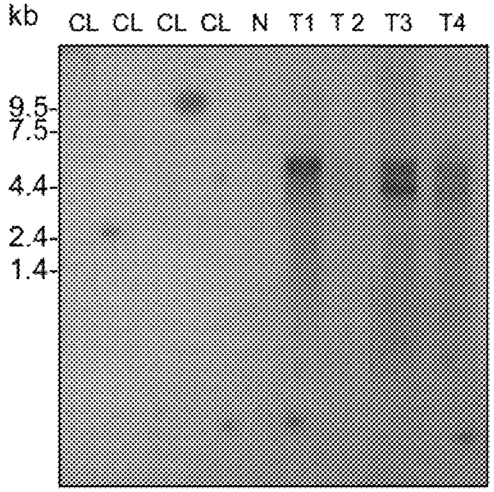

T1 - Invasive Papillary Transitional, grade II
T2 - Non-invasive Transitional, grade 2
T3 - Invasive, Transitional, grade 3
T4 - Squamous carcinoma

*CL = Cell lines (from left to right): HT1197, UM-UC-3, TCCSUP, J82*
*N = Normal Bladder*

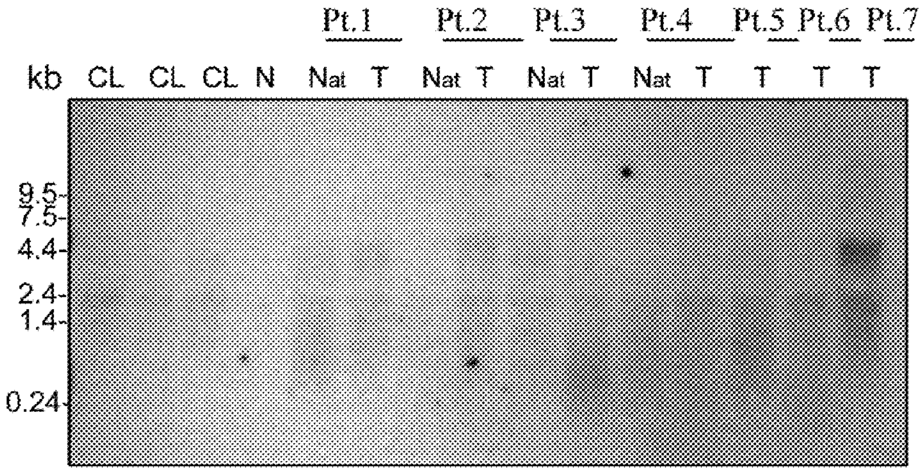

Pt.1 - Transitional, grade 4
Pt.2 - Squamous inv.
Pt.3 - Transitional inv, grade 3/3
Pt.4 - Transitional, grade 3
Pt.5 - Papillary non -inv, grade 1/3
Pt.6 - Papillary, grade 3/3
Pt.7 - Transitional, grade 3/2

*CL = cell lines listed in order: UM-UC-3, J82, SCABER*
*N = Normal Bladder*
*Nat = Normal adjacent tumor*
*T = Tumor*

Figure 60 Expression of 185P2C9 by RT-PCR
M = Marker
1. Vital pool 1
2. Vital pool 2
3. Prostate metastasis to LN
4. Prostate cancer pool
5. Bladder cancer pool
6. Kidney cancer pool
7. Colon cancer pool
8. Lung cancer pool
9. Ovary cancer pool
10. Breast cancer pool
11. Cancer metastasis pool
12. Pancreas cancer pool
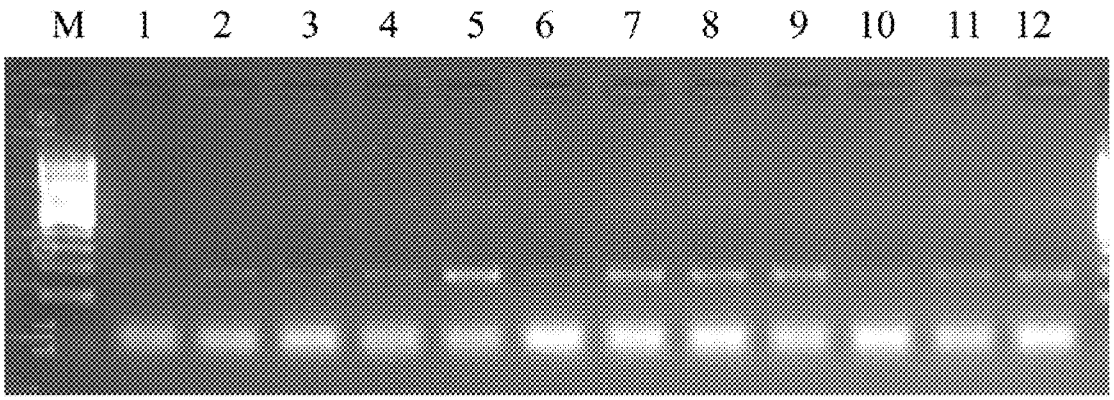
30X

Figure 61 Expression of 185P2C9 in Normal Tissues
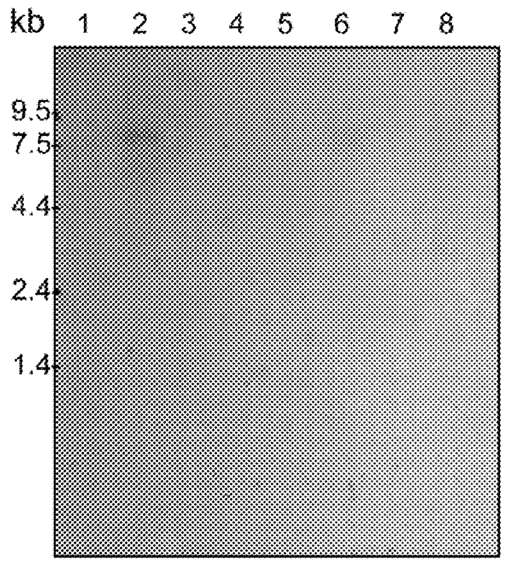
1. Heart
2. Brain
3. Placenta
4. Lung
5. Liver
6. Skeletal Muscle
7. Kidney
8. Pancreas
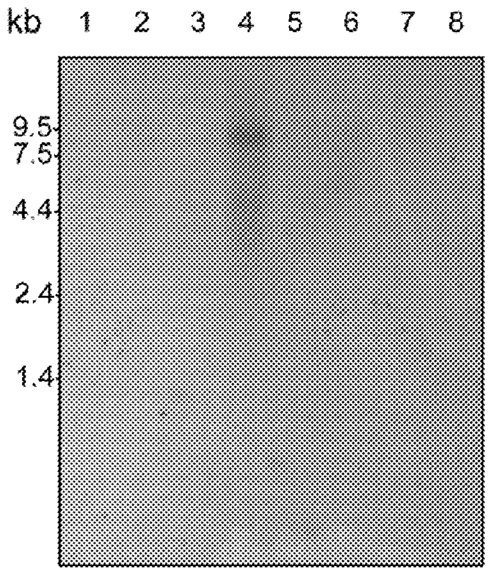
1. Spleen
2. Thymus
3. Prostate
4. Testis
5. Ovary
6. Small Intestine
7. Colon
8. Leukocytes

Figure 62 Expression of 185P2C9 in Bladder Cancer Patient Specimens

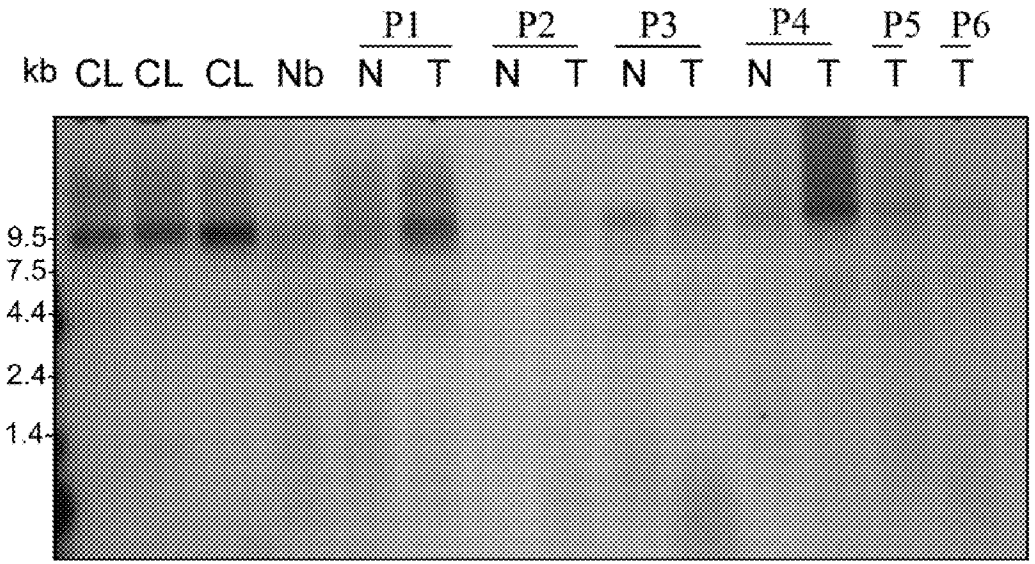

*Cl = cell lines listed in order: UM-UC-3, J82, SCABER*
*P = Patient*
*Nb = Normal Bladder*
*N = Normal adjacent tissue*
*T = Tumor*

P1 - Transitional cell carcinoma, stage 2
P2 - Invasive transitional, grade 3
P3 - Invasive, moderately differentiated transitional, Grade 3
P4 - Non-invasive transitional cell carcinoma
P5 - Invasive papillary transitional, grade II
P6 - Bladder carcinoma of unknown grade

Figure 63 Expression of 185P2C9 in Kidney Cancer Patient Specimens
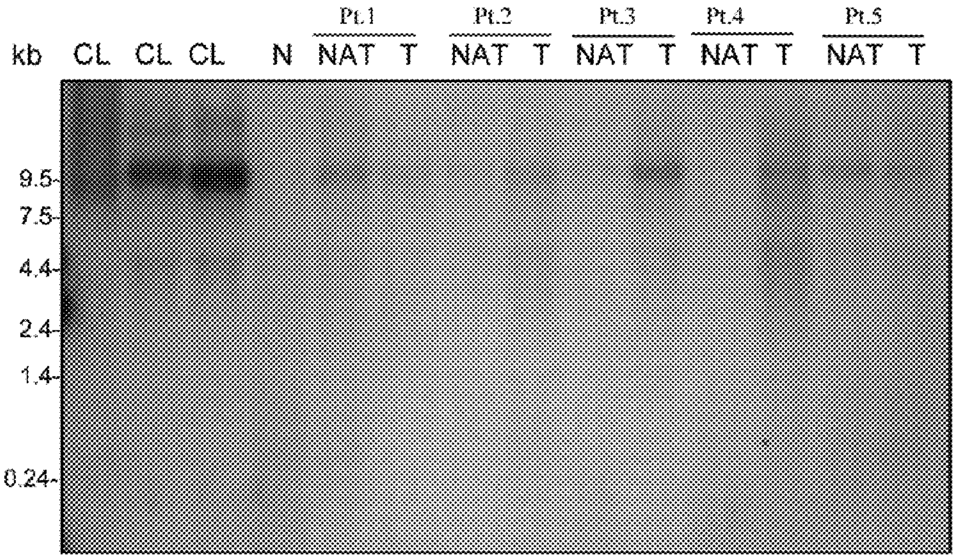
*CL = cell lines listed in order:*
*769-P, A498, Caki-1*
*N = Normal kidney*
*$N_{AT}$ = Normal adjacent tumor*
*T = Tumor*
Pt.1, Papillary carcinoma, grade 2
Pt.2, Clear cell type, grade 2
Pt.3, Clear cell type, grade 2
Pt.4, Clear cell type, grade 2
Pt.5, Clear cell type, grade 3
Pt.6, Clear cell type, grade 3

Figure 64 Expression of 186P1H9 by RT-PCR
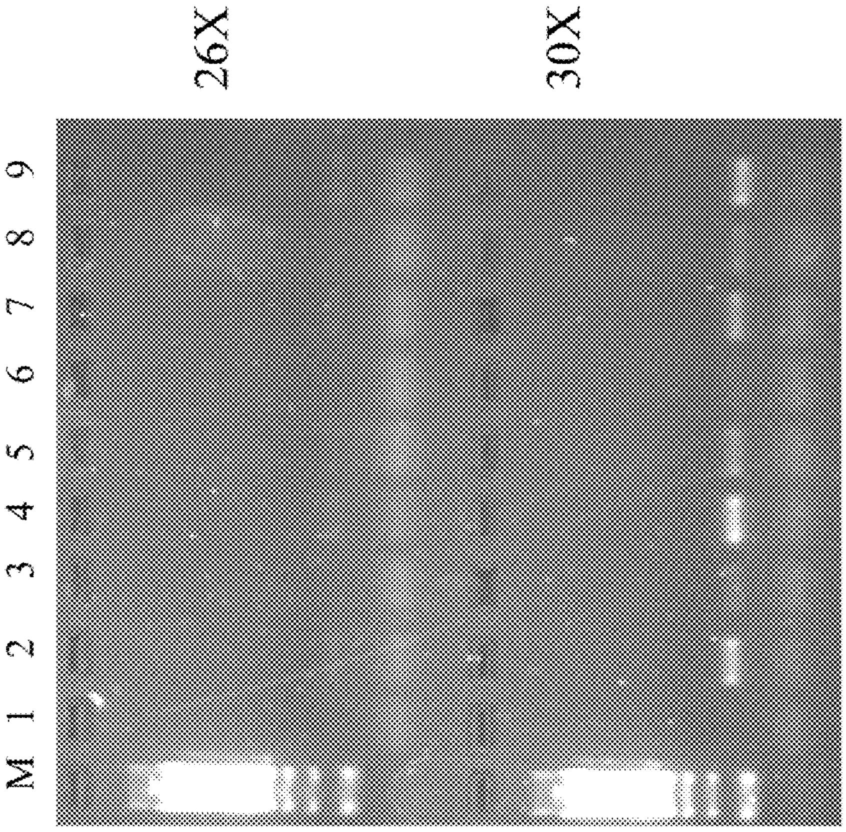
M = Marker
1. Vital pool 1
2. Vital pool 2
3. Bladder cancer pool
4. Kidney cancer pool
5. Colon cancer pool
6. Lung cancer pool
7. Ovary cancer pool
8. Cancer metastasis pool
9. Pancreas cancer pool

Figure 65 Expression of 186P1H9 in Normal Tissues
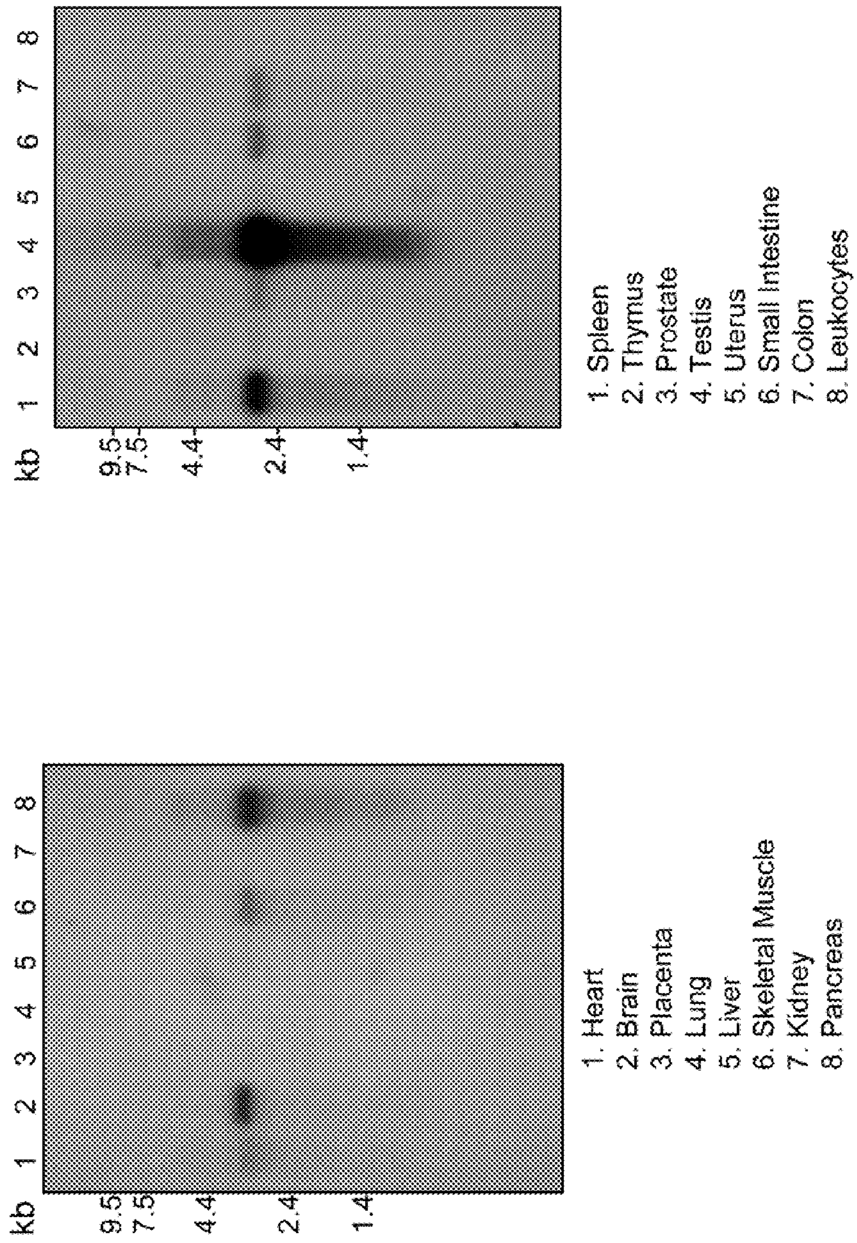

Figure 66 Expression of 186P1H9 in Patient Cancer Specimens and in Normal Tissues
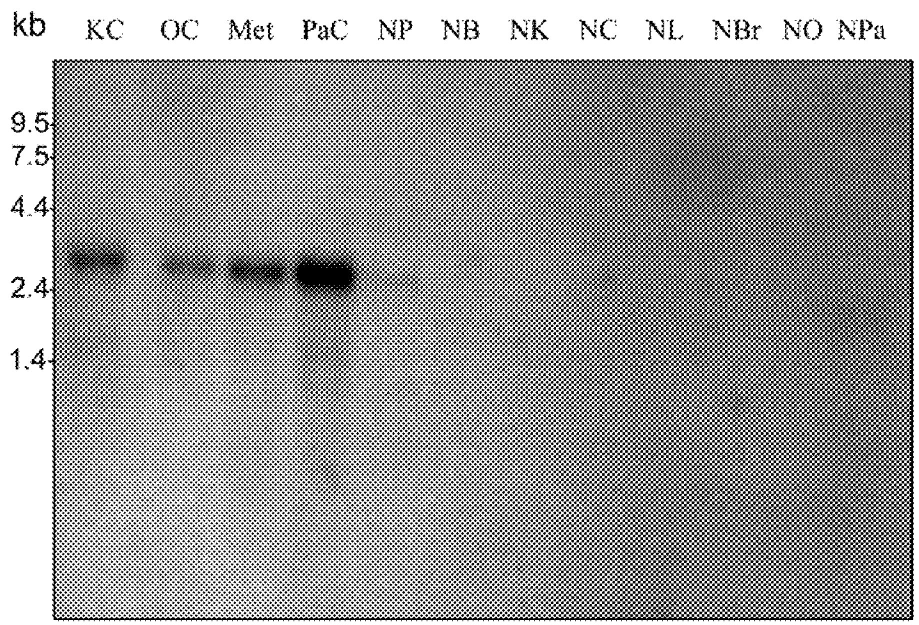
*KC = Kidney cancer pool*
*OC = Ovary cancer pool*
*MC = Cancer metastasis pool*
*PaC = Pancreas cancer pool*
*NP = Normal Prostate*
*NB = Normal Bladder*
*NK = Normal Kidney*
*NC = Normal Colon*
*NL = Normal Lung*
*NBr = Normal Breast*
*NO = Normal Ovary*
*NPr = Normal Pancreas*

Figure 67 Expression of 186P1H9 in Kidney Cancer Patient Specimens
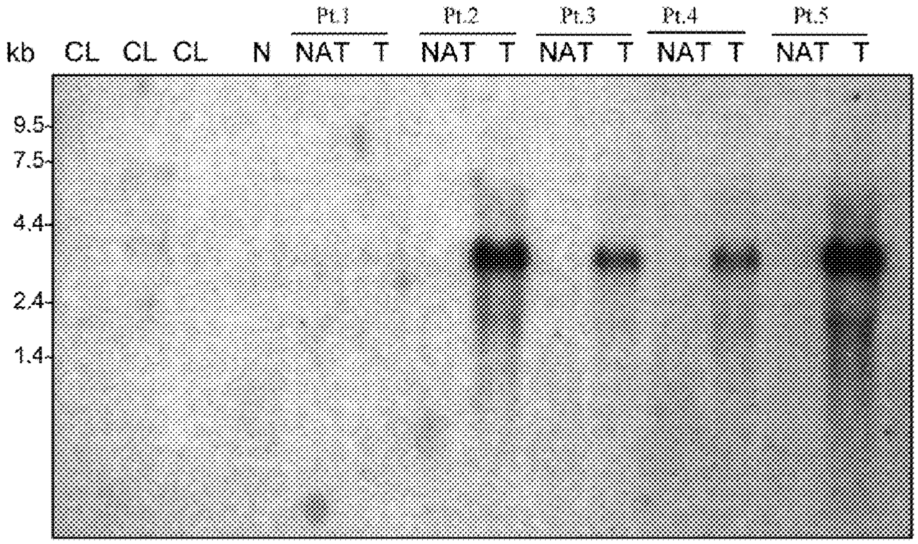
*CL = cell lines listed in order: 769-P, A498, Caki-1*
*N = Normal kidney*
*$N_{AT}$ = Normal adjacent tumor*
*T = Tumor*
Pt.1, Papillary carcinoma, grade 2
Pt.2, Clear cell type, grade 2
Pt.3, Clear cell type, grade 2
Pt.4, Clear cell type, grade 2
Pt.5, Clear cell type, grade 3
Pt.6, Clear cell type, grade 3

Figure 68 Expression of 186P1H9 in Ovarian and Testicular Cancer Patient Specimens
Ovarian Cancer
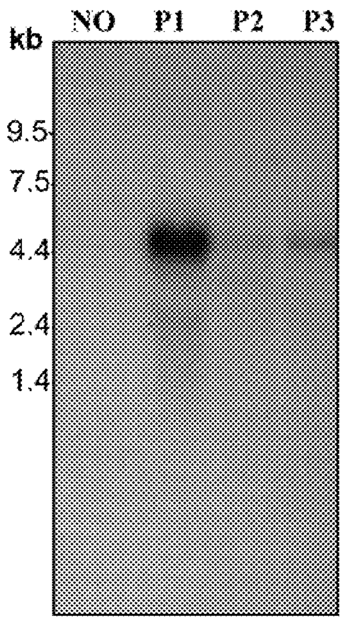
Testicular Cancer
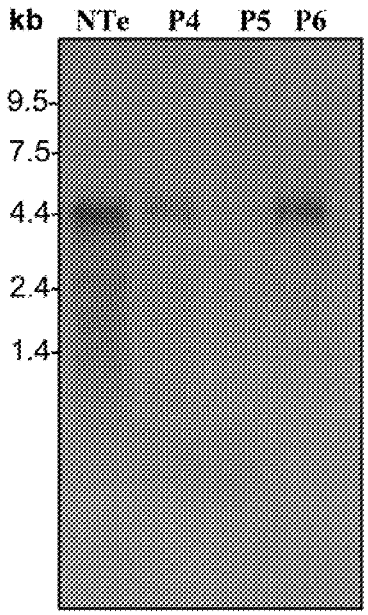
P1 - Ovarian tumor
P2 - Ovarian tumor
P3 - Ovarian tumor
P4 - Testicular tumor
P5 - Testicular tumor
P6 - Testicular tumor
*NO= Normal Ovary*
*NTe = Normal Testis*

<u>Figure 69</u> Expression of 187P3F2 by RT-PCR
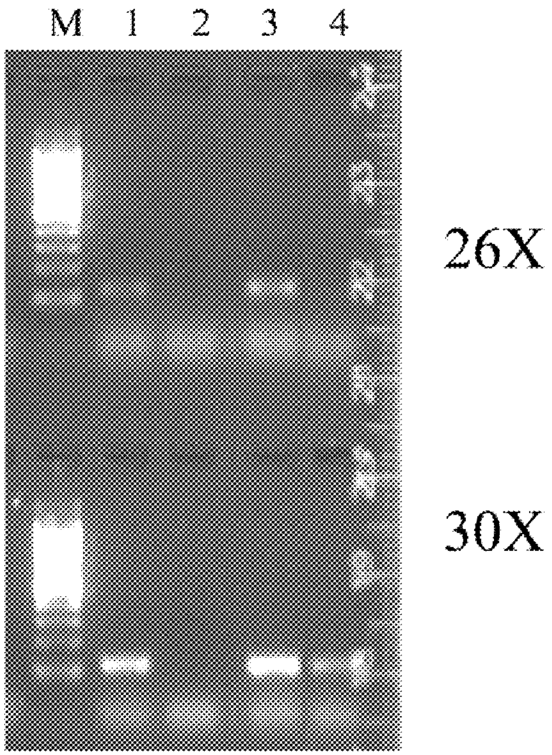
M = Marker
1. Vital pool 1
2. Vital pool 2
3. Kidney cancer pool
4. Pancreas cancer pool

Figure 70 Expression of 187P3F2 in Normal Tissues
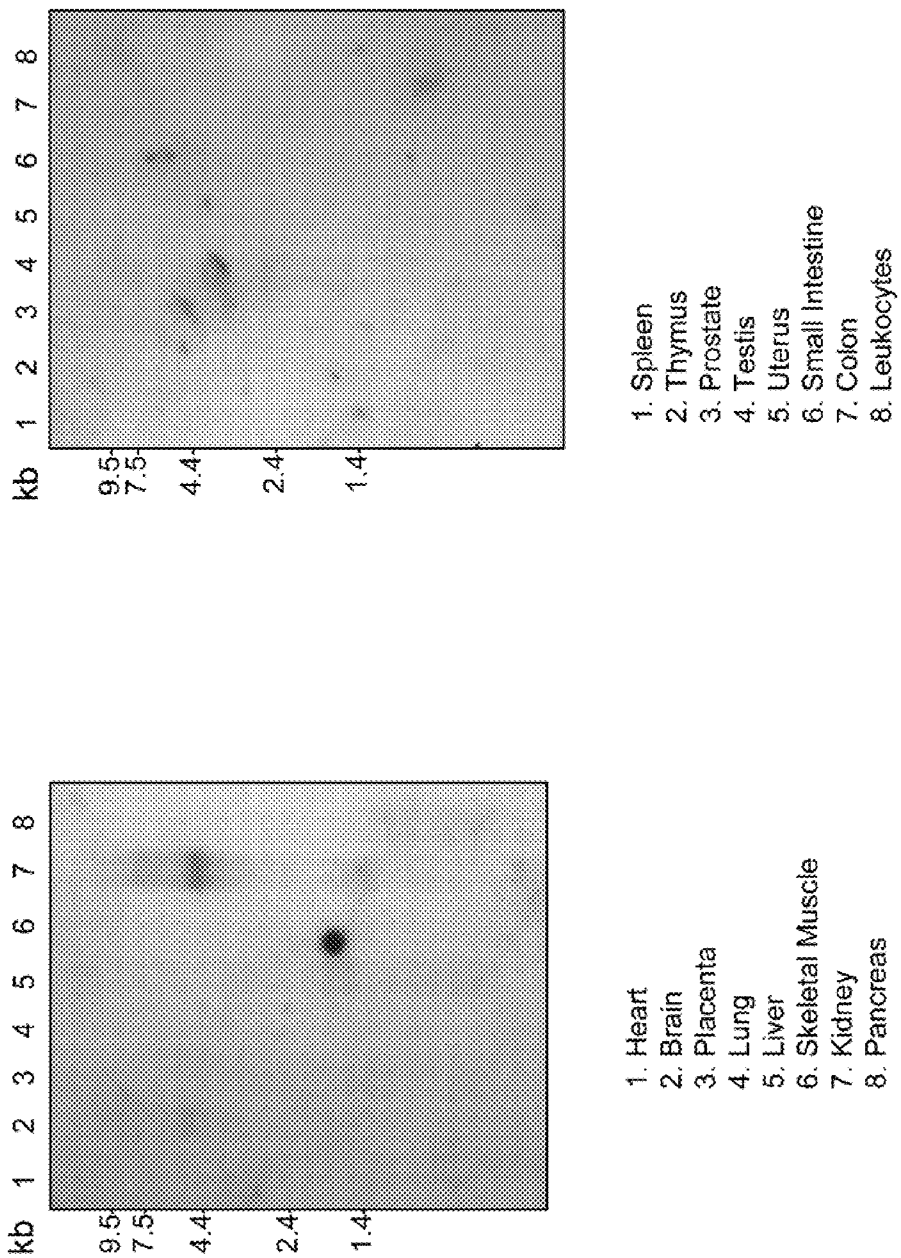

Figure 71 Expression of 187P3F2 in Patient Cancer Specimens and in Normal Tissues
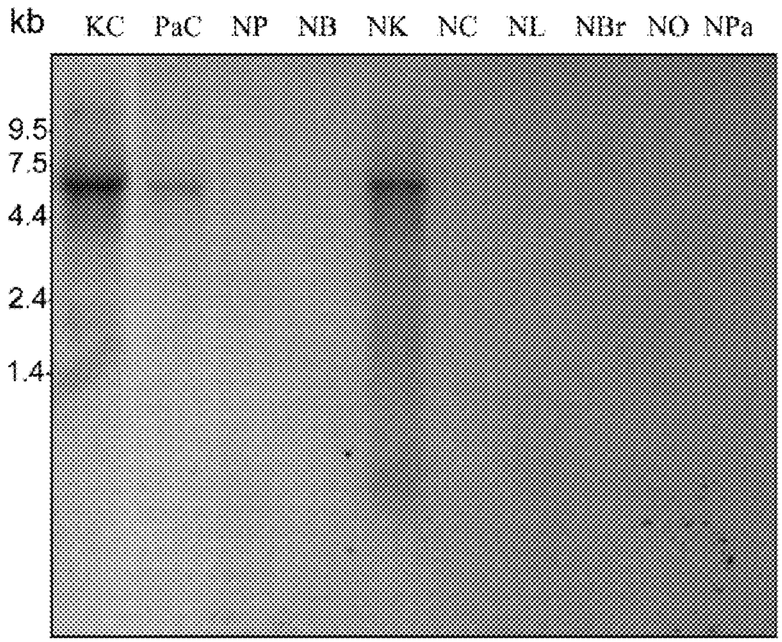
*KC = Kidney cancer pool of 3 patient tumors*
*PaC = Pancreas cancer pool of 3 patient tumors*
*NP = Normal Prostate*
*NB = Normal Bladder*
*NK = Normal Kidney*
*NC = Normal Colon*
*NL = Normal Lung*
*NBr = Normal Breast*
*NO = Normal Ovary*
*NPr = Normal Pancreas*

Figure 72 Expression of 187P3F2 in Pancreas Patient Cancer Specimens
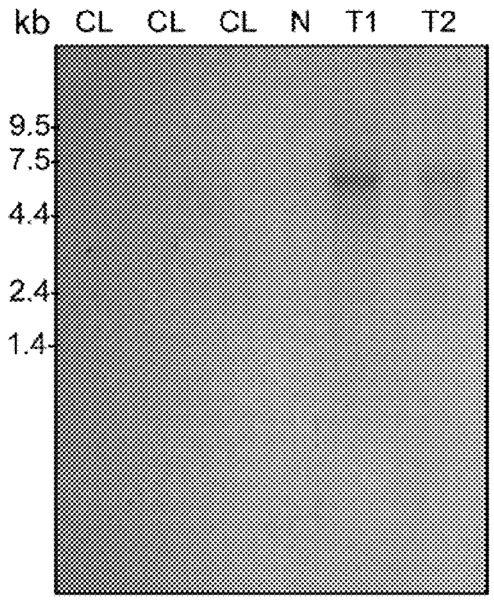
*CL = cell lines listed in order: PANC-1, Bx PC-3, HPAC*
*N = Normal pancreas*
T1 - Pancreas tumor #1
T2 - Pancreas tumor #1

Figure 73 Expression of 192P2G7 by RT-PCR
1. Vital pool 1
2. Vital pool 2
3. Prostate cancer pool
4. Bladder cancer pool
5. Kidney cancer pool
6. Lung cancer pool
7. Ovary cancer pool
8. Breast cancer pool
9. Cancer metastasis pool
10. Pancreas cancer pool
11. Prostate metastasis to LN
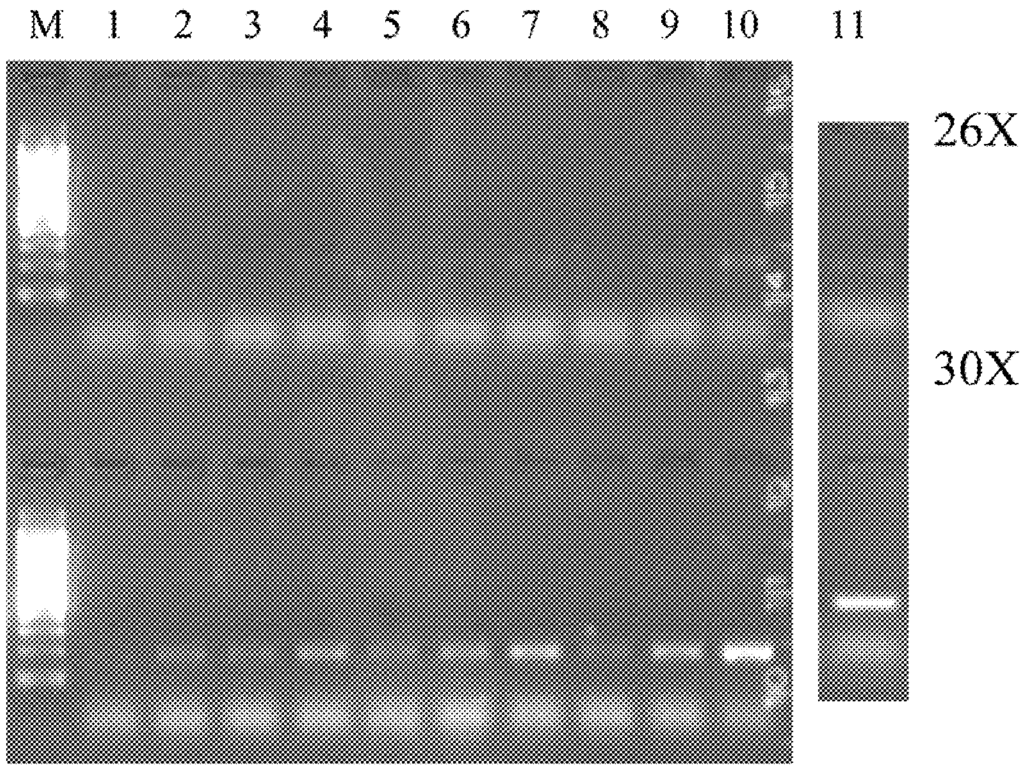

Figure 74 Expression of 185P3C2 by RT-PCR
1. Vital pool 1
2. Vital pool 2
3. Prostate cancer pool
4. Bladder cancer pool
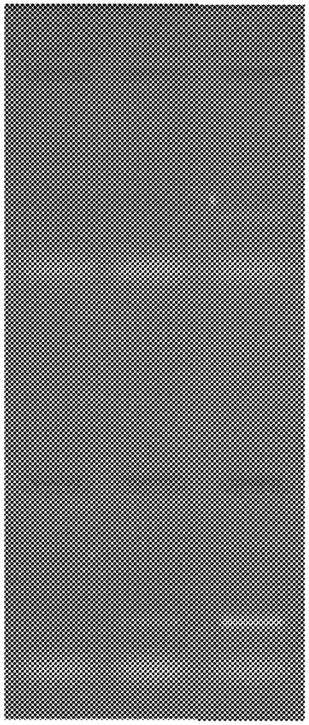

METHODS OF INDUCING AN IMMUNE RESPONSE

CROSS-REFERENCE TO RELATED APPLICATIONS

This application is a divisional of U.S. application Ser. No. 10/121,024, filed Apr. 10, 2002, now pending, which claims the benefit of U.S. Provisional Application Ser. No. 60/283,112, filed Apr. 10, 2001; U.S. Provisional Application Ser. No. 60/282,739, filed Apr. 10, 2001; and U.S. Provisional Application Ser. No. 60/286,630, filed Apr. 25, 2001. The contents of these applications are herein incorporated by reference in their entirety.

The content of the following submission on compact discs is incorporated herein by reference in its entirety: A computer readable form (CRF) of the Sequence Listing on compact disc (file name: 511582004002, date recorded: Nov. 14, 2005, size: 983,040 bytes); a duplicate compact disc copy of the Sequence Listing (COPY 1) (file name: 511582004002, date recorded: Nov. 14, 2005, size: 983,040 bytes); and a duplicate compact disc copy of the Sequence Listing (COPY 2) (file name: 511582004002, date recorded: Nov. 14, 2005, size: 983,040 bytes).

STATEMENT OF RIGHTS TO INVENTIONS MADE UNDER FEDERALLY SPONSORED RESEARCH

Not applicable.

FIELD OF THE INVENTION

The invention described herein relates to a gene and its encoded proteins set forth, e.g., in FIG. 2 expressed in certain cancers, and to diagnostic and therapeutic methods and compositions useful in the management of cancers that express a gene of FIG. 2.

BACKGROUND OF THE INVENTION

Cancer is the second leading cause of human death next to coronary disease. Worldwide, millions of people die from cancer every year. In the United States alone, as reported by the American Cancer Society, cancer causes the death of well over a half-million people annually, with over 1.2 million new cases diagnosed per year. While deaths from heart disease have been declining significantly, those resulting from cancer generally are on the rise. In the early part of the next century, cancer is predicted to become the leading cause of death.

Worldwide, several cancers stand out as the leading killers. In particular, carcinomas of the lung, prostate, breast, colon, pancreas, and ovary represent the primary causes of cancer death. These and virtually all other carcinomas share a common lethal feature. With very few exceptions, metastatic disease from a carcinoma is fatal. Moreover, even for those cancer patients who initially survive their primary cancers, common experience has shown that their lives are dramatically altered. Many cancer patients experience strong anxieties driven by the awareness of the potential for recurrence or treatment failure. Many cancer patients experience physical debilitations following treatment. Furthermore, many cancer patients experience a recurrence.

Worldwide, prostate cancer is the fourth most prevalent cancer in men. In North America and Northern Europe, it is by far the most common cancer in males and is the second leading cause of cancer death in men. In the United States alone, well over 30,000 men die annually of this disease—second only to lung cancer. Despite the magnitude of these figures, there is still no effective treatment for metastatic prostate cancer. Surgical prostatectomy, radiation therapy, hormone ablation therapy, surgical castration and chemotherapy continue to be the main treatment modalities. Unfortunately, these treatments are ineffective for many and are often associated with undesirable consequences.

On the diagnostic front, the lack of a prostate tumor marker that can accurately detect early-stage, localized tumors remains a significant limitation in the diagnosis and management of this disease. Although the serum prostate specific antigen (PSA) assay has been a very useful tool, however its specificity and general utility is widely regarded as lacking in several important respects.

Progress in identifying additional specific markers for prostate cancer has been improved by the generation of prostate cancer xenografts that can recapitulate different stages of the disease in mice. The LAPC (Los Angeles Prostate Cancer) xenografts are prostate cancer xenografts that have survived passage in severe combined immune deficient (SCID) mice and have exhibited the capacity to mimic the transition from androgen dependence to androgen independence (Klein et al., 1997, Nat. Med. 3:402). More recently identified prostate cancer markers include PCTA-1 (Su et al., 1996, Proc. Natl. Acad. Sci. USA 93: 7252), prostate-specific membrane (PSM) antigen (Pinto et al., Clin Cancer Res 1996 Sep. 2 (9): 1445-51), STEAP (Hubert, et al., Proc Natl Acad Sci USA. 1999 Dec. 7; 96(25): 14523-8) and prostate stem cell antigen (PSCA) (Reiter et al., 1998, Proc. Natl. Acad. Sci. USA 95: 1735).

While previously identified markers such as PSA, PSM, PCTA and PSCA have facilitated efforts to diagnose and treat prostate cancer, there is need for the identification of additional markers and therapeutic targets for prostate and related cancers in order to further improve diagnosis and therapy.

Renal cell carcinoma (RCC) accounts for approximately 3 percent of adult malignancies. Once adenomas reach a diameter of 2 to 3 cm, malignant potential exists. In the adult, the two principal malignant renal tumors are renal cell adenocarcinoma and transitional cell carcinoma of the renal pelvis or ureter. The incidence of renal cell adenocarcinoma is estimated at more than 29,000 cases in the United States, and more than 11,600 patients died of this disease in 1998. Transitional cell carcinoma is less frequent, with an incidence of approximately 500 cases per year in the United States.

Surgery has been the primary therapy for renal cell adenocarcinoma for many decades. Until recently, metastatic disease has been refractory to any systemic therapy. With recent developments in systemic therapies, particularly immunotherapies, metastatic renal cell carcinoma may be approached aggressively in appropriate patients with a possibility of durable responses. Nevertheless, there is a remaining need for effective therapies for these patients.

Of all new cases of cancer in the United States, bladder cancer represents approximately 5 percent in men (fifth most common neoplasm) and 3 percent in women (eighth most common neoplasm). The incidence is increasing slowly, concurrent with an increasing older population. In 1998, there was an estimated 54,500 cases, including 39,500 in men and 15,000 in women. The age-adjusted incidence in the United States is 32 per 100,000 for men and 8 per 100,000 in women. The historic male/female ratio of 3:1 may be decreasing related to smoking patterns in women. There were an estimated 11,000 deaths from bladder cancer in 1998 (7,800 in men and 3,900 in women). Bladder cancer incidence and mortality strongly increase with age and will be an increasing problem as the population becomes more elderly.

Most bladder cancers recur in the bladder. Bladder cancer is managed with a combination of transurethral resection of the bladder (TUR) and intravesical chemotherapy or immunotherapy. The multifocal and recurrent nature of bladder cancer points out the limitations of TUR. Most muscle-invasive cancers are not cured by TUR alone. Radical cystectomy and urinary diversion is the most effective means to eliminate the cancer but carry an undeniable impact on urinary and sexual function. There continues to be a significant need for treatment modalities that are beneficial for bladder cancer patients.

An estimated 130,200 cases of colorectal cancer occurred in 2000 in the United States, including 93,800 cases of colon cancer and 36,400 of rectal cancer. Colorectal cancers are the third most common cancers in men and women. Incidence rates declined significantly during 1992-1996 (−2.1% per year). Research suggests that these declines have been due to increased screening and polyp removal, preventing progression of polyps to invasive cancers. There were an estimated 56,300 deaths (47,700 from colon cancer, 8,600 from rectal cancer) in 2000, accounting for about 11% of all U.S. cancer deaths.

At present, surgery is the most common form of therapy for colorectal cancer, and for cancers that have not spread, it is frequently curative. Chemotherapy, or chemotherapy plus radiation, is given before or after surgery to most patients whose cancer has deeply perforated the bowel wall or has spread to the lymph nodes. A permanent colostomy (creation of an abdominal opening for elimination of body wastes) is occasionally needed for colon cancer and is infrequently required for rectal cancer. There continues to be a need for effective diagnostic and treatment modalities for colorectal cancer.

There were an estimated 164,100 new cases of lung and bronchial cancer in 2000, accounting for 14% of all U.S. cancer diagnoses. The incidence rate of lung and bronchial cancer is declining significantly in men, from a high of 86.5 per 100,000 in 1984 to 70.0 in 1996. In the 1990s, the rate of increase among women began to slow. In 1996, the incidence rate in women was 42.3 per 100,000.

Lung and bronchial cancer caused an estimated 156,900 deaths in 2000, accounting for 28% of all cancer deaths. During 1992-1996, mortality from lung cancer declined significantly among men (−1.7% per year) while rates for women were still significantly increasing (0.9% per year). Since 1987, more women have died each year of lung cancer than breast cancer, which, for over 40 years, was the major cause of cancer death in women. Decreasing lung cancer incidence and mortality rates most likely resulted from decreased smoking rates over the previous 30 years; however, decreasing smoking patterns among women lag behind those of men. Of concern, although the declines in adult tobacco use have slowed, tobacco use in youth is increasing again.

Treatment options for lung and bronchial cancer are determined by the type and stage of the cancer and include surgery, radiation therapy, and chemotherapy. For many localized cancers, surgery is usually the treatment of choice. Because the disease has usually spread by the time it is discovered, radiation therapy and chemotherapy are often needed in combination with surgery. Chemotherapy alone or combined with radiation is the treatment of choice for small cell lung cancer; on this regimen, a large percentage of patients experience remission, which in some cases is long lasting. There is however, an ongoing need for effective treatment and diagnostic approaches for lung and bronchial cancers.

An estimated 182,800 new invasive cases of breast cancer were expected to occur among women in the United States during 2000. Additionally, about 1,400 new cases of breast cancer were expected to be diagnosed in men in 2000. After increasing about 4% per year in the 1980s, breast cancer incidence rates in women have leveled off in the 1990s to about 110.6 cases per 100,000.

In the U.S. alone, there were an estimated 41,200 deaths (40,800 women, 400 men) in 2000 due to breast cancer. Breast cancer ranks second among cancer deaths in women. According to the most recent data, mortality rates declined significantly during 1992-1996 with the largest decreases in younger women, both white and black. These decreases were probably the result of earlier detection and improved treatment.

Taking into account the medical circumstances and the patient's preferences, treatment of breast cancer may involve lumpectomy (local removal of the tumor) and removal of the lymph nodes under the arm; mastectomy (surgical removal of the breast) and removal of the lymph nodes under the arm; radiation therapy; chemotherapy; or hormone therapy. Often, two or more methods are used in combination. Numerous studies have shown that, for early stage disease, long-term survival rates after lumpectomy plus radiotherapy are similar to survival rates after modified radical mastectomy. Significant advances in reconstruction techniques provide several options for breast reconstruction after mastectomy. Recently, such reconstruction has been done at the same time as the mastectomy.

Local excision of ductal carcinoma in situ (DCIS) with adequate amounts of surrounding normal breast tissue may prevent the local recurrence of the DCIS. Radiation to the breast and/or tamoxifen may reduce the chance of DCIS occurring in the remaining breast tissue. This is important because DCIS, if left untreated, may develop into invasive breast cancer. Nevertheless, there are serious side effects or sequelae to these treatments. There is, therefore, a need for efficacious breast cancer treatments.

There were an estimated 23,100 new cases of ovarian cancer in the United States in 2000. It accounts for 4% of all cancers among women and ranks second among gynecologic cancers. During 1992-1996, ovarian cancer incidence rates were significantly declining. Consequent to ovarian cancer, there were an estimated 14,000 deaths in 2000. Ovarian cancer causes more deaths than any other cancer of the female reproductive system.

Surgery, radiation therapy, and chemotherapy are treatment options for ovarian cancer. Surgery usually includes the removal of one or both ovaries, the fallopian tubes (salpingo-oophorectomy), and the uterus (hysterectomy). In some very early tumors, only the involved ovary will be removed, especially in young women who wish to have children. In advanced disease, an attempt is made to remove all intra-abdominal disease to enhance the effect of chemotherapy. There continues to be an important need for effective treatment options for ovarian cancer.

There were an estimated 28,300 new cases of pancreatic cancer in the United States in 2000. Over the past 20 years, rates of pancreatic cancer have declined in men. Rates among women have remained approximately constant but may be beginning to decline. Pancreatic cancer caused an estimated 28,200 deaths in 2000 in the United States. Over the past 20 years, there has been a slight but significant decrease in mortality rates among men (about −0.9% per year) while rates have increased slightly among women.

Surgery, radiation therapy, and chemotherapy are treatment options for pancreatic cancer. These treatment options can extend survival and/or relieve symptoms in many patients but are not likely to produce a cure for most. There is a significant need for additional therapeutic and diagnostic options for pancreatic cancer.

SUMMARY OF THE INVENTION

The present invention relates to genes and respective encoded proteins set forth in FIG. 2, that have now been found to be over-expressed in the cancer(s) listed in Table I. Northern blot expression analysis of the genes of FIG. 2 in normal tissues shows a restricted expression pattern in adult tissues. The nucleotide (FIG. 2) and amino acid (FIG. 2, and FIG. 3) sequences of FIG. 2 are provided. The tissue-related expression profile of the genes set forth in FIG. 2 in normal adult tissues, combined with the over-expression observed in the tumors listed in Table I, shows that the genes of FIG. 2 are aberrantly over-expressed in certain cancers, and thus serves as a useful diagnostic, prophylactic, prognostic, and/or therapeutic target for cancers of the tissue(s) such as those listed in Table I.

The invention provides polynucleotides corresponding or complementary to all or part of the genes of FIG. 2, corresponding/related mRNAs, coding and/or complementary sequences, preferably in isolated form, including polynucleotides encoding FIG. 2-*related* proteins and fragments of 4, 5, 6, 7, 8, 9, 10, 11, 12, 13, 14, 15, 16, 17, 18, 19, 20, 21, 22, 23, 24, 25, or more than 25 contiguous amino acids of a FIG. 2-*related* protein; at least 30, 35, 40, 45, 50, 55, 60, 65, 70, 80, 85, 90, 95, 100 or more than 100 contiguous amino acids of a FIG. 2-*related* protein, as well as the peptides/proteins themselves; DNA, RNA, DNA/RNA hybrids, and related molecules such as, polynucleotides or oligonucleotides complementary or having at least a 90% homology to the genes set forth in FIG. 2 or mRNA sequences or parts thereof, and polynucleotides or oligonucleotides that hybridize to the genes set forth in FIG. 2, mRNAs, or to polynucleotides that encode proteins of FIG. 2 or FIG. 3 or analogs or variants thereof; or to polynucleotides that encode proteins of fragments of a peptide of FIG. 2 or FIG. 3 such as set forth in Tables V to XVIII, Table XX, Tables XXIII to XXVI, or analogs or variants thereof; or to polynucleotides that encode fragments/subsequences of a peptide of FIG. 2 or FIG. 3 such as any 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 205, 210, 215, 220, 225, 230, 235, 240, 245, 250, 255, 260, 265, 270, 275, 280, 285, 290, 295, 300, 305, 310, 315, 320, 325, 330, 335, 340, 345, 350, 355, 360, 365, 370, 375, 380, 385, 390, 395, 400, 405, 410, 415, 420, 425, 430, 435, 440, 445, 450, 455, 460, 465, 470, 475, 480, 485, 490, 495, 500, 505, 510, 515, 520, 525, 530, 535, 540, 545, 550, 555, 560, 565, 570, 575, 580, 585, 590, 595, 600, 605, 610, 615, 620, 625, 630, 635, 640, 645, 650, 655, 660, 665, 670, 675, 680, 685, 690, 695, 700, 705, 710, 715, 720, 725, 730, 735, 740, 745, 750, 755, 760, 765, 770, 775, 780, 785, 790, 795, 800, 805, 810, 815, 820, 825, 830, 835, 840, 845, 850, 855, 860, 865, 870, 875, 880, 885, 890, 895, 900, 905, 910, 915, 920, 925, 930, 935, 940, 945, 950, 955, 960, 965, 970, 975, 980, 985, 990, 995, 1000, 1025, 1050, 1075, 1100, 1125, 1150, 1175, 1200, etc., or more contiguous amino acids of a peptide of FIG. 2 or 3, or an analog or variant thereof.

Also provided are means for isolating cDNAs and the genes encoding proteins set forth in FIG. 2. Recombinant DNA molecules containing genes of FIG. 2 polynucleotides, cells transformed or transduced with such molecules, and host-vector systems for the expression of the genes set forth in FIG. 2 products are also provided. The invention further provides antibodies that bind to the proteins set forth in FIG. 2 and polypeptide fragments thereof, including polyclonal and monoclonal antibodies, murine and other mammalian antibodies, chimeric antibodies, humanized and fully human antibodies, and antibodies labeled with a detectable marker or therapeutic agent. In certain embodiments there is a proviso that the entire nucleic acid sequence of the genes of FIG. 2 is not encoded and/or the entire amino acid sequence of the proteins of FIG. 2 is not prepared. In certain embodiments, the entire nucleic acid sequence of the genes of FIG. 2 is encoded and/or the entire amino acid sequence of the proteins of FIG. 2 is prepared, either of which are in respective human unit dose forms.

The invention further provides methods for detecting the presence and status of FIG. 2 polynucleotides and proteins in various biological samples, as well as methods for identifying cells that express the genes set forth in FIG. 2. A typical embodiment of this invention provides methods for monitoring the FIG. 2 gene products in a tissue or hematology sample having or suspected of having some form of growth dysregulation such as cancer.

The invention further provides various immunogenic or therapeutic compositions and strategies for treating cancers that express a gene set forth in FIG. 2 such as cancers of tissues listed in Table I, including therapies aimed at inhibiting the transcription, translation, processing or function of the genes of FIG. 2 as well as cancer vaccines. In one aspect, the invention provides compositions, and methods comprising them, for treating a cancer that expresses a gene set forth in FIG. 2 in a human subject wherein the composition comprises a carrier suitable for human use and a human unit dose of one or more than one agent that inhibits the production or function of a gene or proteins of FIG. 2. Preferably, the carrier is a uniquely for use in humans. In another aspect of the invention, the agent is a moiety that is immunoreactive with a protein of FIG. 2. Non-limiting examples of such moieties include, but are not limited to, antibodies (such as single chain, monoclonal, polyclonal, humanized, chimeric, or human antibodies), functional equivalents thereof (whether naturally occurring or synthetic), and combinations thereof. The antibodies can be conjugated to a diagnostic or therapeutic moiety. In another aspect, the agent is a small molecule as defined herein.

In another aspect, the agent comprises one or more than one peptide which comprises a cytotoxic T lymphocyte (CTL) epitope that binds an HLA class I molecule in a human to elicit a CTL response to a protein of FIG. 2 and/or one or more than one peptide which comprises a helper T lymphocyte (HTL) epitope which binds an HLA class II molecule in a human to elicit an HTL response. The peptides of the invention may be on the same or on one or more separate polypeptide molecules. In a further aspect of the invention, the agent comprises one or more than one nucleic acid molecule that expresses one or more than one of the CTL or HTL response stimulating peptides as described above. In yet another aspect of the invention, the one or more than one nucleic acid molecule may express a moiety that is immunologically reactive with a protein of FIG. 2 as described above. The one or more than one nucleic acid molecule may also be, or encodes, a molecule that inhibits production of a protein set forth in FIG. 2. Non-limiting examples of such molecules include, but are not limited to, those complementary to a nucleotide sequence essential for production of a protein of FIG. 2 (e.g. antisense sequences or molecules that form a triple helix with a nucleotide double helix essential for production of a protein set forth in FIG. 2) or a ribozyme effective to lyse mRNA (sense or antisense) encoded by a gene of FIG. 2.

Please note, to determine the starting position of any peptide set forth in Tables V-XVIII and Tables XXIII to XXVI (collectively HLA Peptide Tables) respective to its parental protein in FIG. 2 or FIG. 3, reference is made to its respective protein.

One embodiment of the invention comprises an HLA peptide, that occurs at least twice in Tables V-XVIII and XXIII to XXVI collectively, or an oligonucleotide that encodes the HLA peptide. Another embodiment of the invention comprises an HLA peptide that occurs at least twice in Tables V-XVIII, or an oligonucleotide that encodes the HLA peptide. Another embodiment of the invention comprises an HLA peptide that occurs at least twice in Tables XXIII to XXVI, or an oligonucleotide that encodes the HLA peptide. Another embodiment of the invention comprises an HLA peptide that occurs at least once in Tables V-XVIII and is embedded within at least one peptide in Tables XXIII to XXVI, or an oligonucleotide that encodes the HLA peptide.

Another embodiment of the invention is antibody epitopes which comprise a peptide region, or an oligonucleotide encoding the peptide region, that has one two, three, four, or five of the following characteristics:

i) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Hydrophilicity profile of FIG. 5;

ii) a peptide region of at least 5 amino acids of a particular peptide of FIG. 3, in any whole number increment up to the full length of that protein in FIG. 3, that includes an amino acid position having a value equal to or less than 0.5, 0.4, 0.3, 0.2, 0.1, or having a value equal to 0.0, in the Hydropathicity profile of FIG. 6;

iii) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Percent Accessible Residues profile of FIG. 7;

iv) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Average Flexibility profile of FIG. 8; or v) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Beta-turn profile of FIG. 9.

BRIEF DESCRIPTION OF THE FIGURES

FIGS. 1A-1R. The SSH sequences of the invention.

FIGS. 2A.1-2R. Genes and respective encoded proteins of the invention.

FIGS. 3A.1-3R. Amino acid sequences of the invention.

FIG. 4. Nucleic acid sequence and protein alignments.

FIGS. 10A-10Z. Secondary structure predictions for the proteins set forth in FIG. 2. The sequence identifiers for the respective amino acids are as follows: 74P3B3 v1 (SEQ ID NO 689), 74P3B3 v2 (SEQ ID NO 690), 83P4B8 (SEQ ID NO 691), 109P1D4 (SEQ ID NO 692), 151P4E11 (SEQ ID NO 693), 151P1C7a (SEQ ID NO 694), 154P2A8 (SEQ ID NO 695), 156P1D4 (SEQ ID NO 696), 156P5C12 (SEQ ID NO 697), 159P2B5 (SEQ ID NO 698), 161P2B7a (SEQ ID NO 699), 179P3G7 (SEQ ID NO 700), 184P3C10B (SEQ ID NO 701), 184P3G10 (SEQ ID NO 702), 185P2C9 v1 (SEQ ID NO 703), 185P2C9 v2 (SEQ ID NO 704), 185P3C2 (SEQ ID NO 705), 186P1H9 (SEQ ID NO 706), 187P3F2 (SEQ ID NO 707), 192P2G7 (SEQ ID NO 708). The secondary structures of the proteins set forth in FIG. 2 were predicted using the HNN—Hierarchical Neural Network method. This method predicts the presence and location of alpha helices, extended strands, and random coils from the primary protein sequence. The percent of the protein in a given secondary structure is also listed for each variant.

Figure 5B:
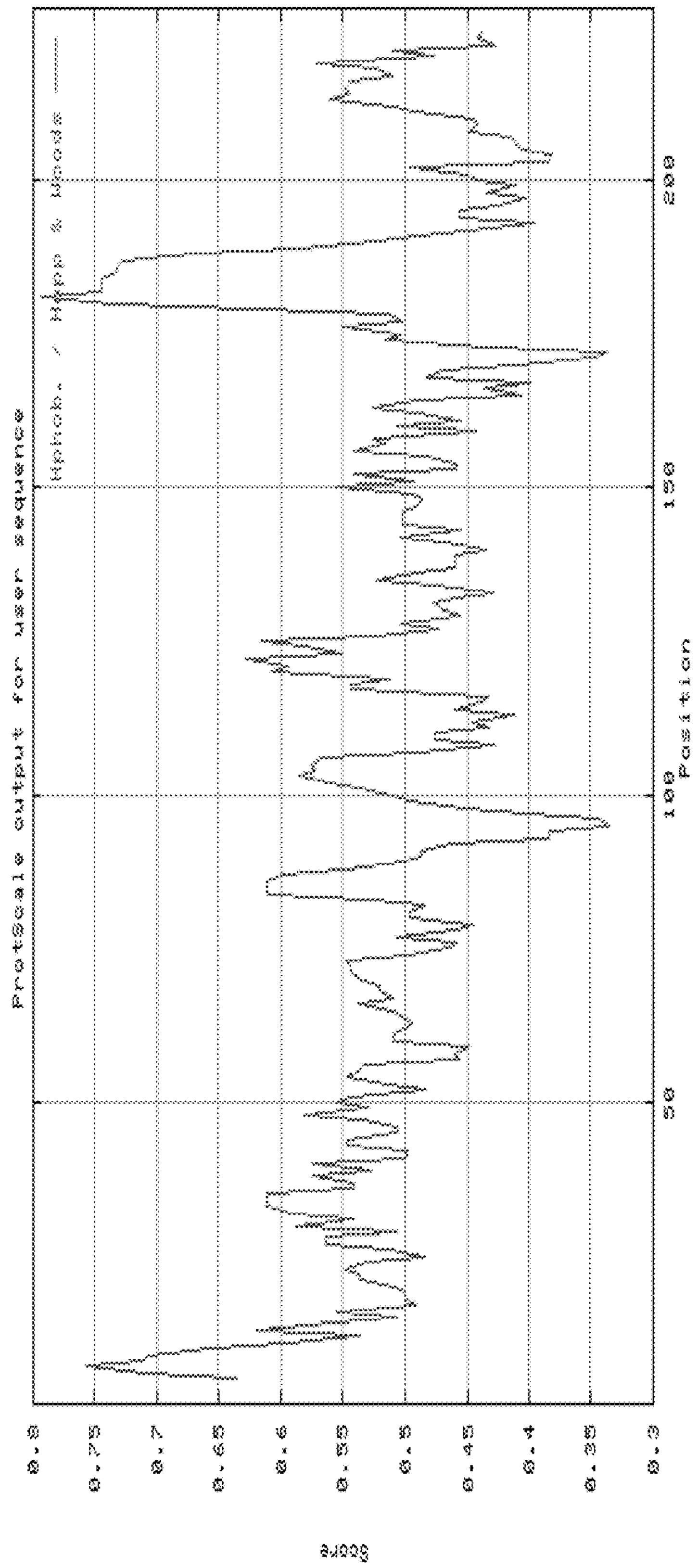
FIGS. 5A-5U. Hydrophilicity amino acid profile of the proteins set forth in FIG. 2 determined by computer algorithm sequence analysis using the method of Hopp and Woods (Hopp T. P., Woods K. R., 1981. Proc. Natl. Acad. Sci. U.S.A. 78:3824-3828).

Transmembrane predictions for the proteins set forth in FIG. 2. Schematic representations of the probability of existence of transmembrane regions and orientation of the proteins of FIG. 2 based on the TMpred algorithm of Hofmann and Stoffel which utilizes TMBASE (K. Hofmann, W. Stoffel. TMBASE—A database of membrane spanning protein segments Biol. Chem. Hoppe-Seyler 374:166, 1993). Schematic representation of the probability of the existence of transmembrane regions and the extracellular and intracellular orientation of the proteins of FIG. 2 based on the TMHMM algorithm of Sonnhammer, von Heijne, and Krogh (Erik L. L. Sonnhammer, Gunnar von Heijne, and Anders Krogh: A hidden Markov model for predicting transmembrane helices in protein sequences. In Proc. of Sixth Int. Conf. on Intelligent Systems for Molecular Biology, p 175-182 Ed J. Glasgow, T. Littlejohn, F. Major, R. Lathrop, D. Sankoff, and C. Sensen Menlo Park, Calif.: AAAI Press, 1998).

FIGS. 11*b*, 11*c*, 11*e*, 11*j*, 11*k*, 11*m*, 11*n*, 11*o*, and 11*r*. The nucleotide sequences of transcript variants of the invention.

FIGS. 12*b*, 12*c*, 12*e*, 12*j*, 12*k*, 12*m*, 12*n*, 12*o*, and 12*r*. These Figures show amino acid sequences of proteins translated from the corresponding transcript variants set forth in FIG. 11.

FIGS. 13*b*, 13*c*, 13*e*, 13*j*, 13*k*, 13*m*, 13*n*, 13*o*, and 13*r*. These Figures display the alignment of the nucleotide sequences of respective transcript variants.

FIGS. 14*b*, 14*c*, 14*e*, 14*j*, 14*k*, 14*m*, 14*n*, 14*o*, and 14*r*. These Figures display the alignment of the protein sequences from the respective transcript variants. The sub-numbering nomenclature of FIG. 11 through FIG. 14 is set forth in the following legend:

| FIG. 11-14 Sub-part | Target |
|---|---|
| A | 074P3B3 |
| B | 083P4B8 |
| C | 109P1D4 |
| D | 151P1C7A |
| E | 151P4E11 |
| F | 154P2A8 |
| G | 156P1D4 |
| H | 156P5C12 |
| I | 159P2B5 |
| J | 161P2B7a |
| K | 179P3G7 |
| L | 184P3C10B |
| M | 184P3G10 |
| N | 185P2C9 |
| O | 185P3C2 |
| P | 186P1H9 |
| Q | 187P3F2 |
| R | 192P2G7 |

FIG. 15. Expression of 74P3B3 by RT-PCR. First strand cDNA was prepared from vital pool 1 (liver, lung and kidney), vital pool 2 (pancreas, colon and stomach), two prostate metastasis to lymph node (LN) harvested from two different patients, prostate cancer pool, bladder cancer pool, and cancer metastasis pool. Normalization was performed by PCR using primers to actin and GAPDH. Semi-quantitative PCR, using primers to 74P3B3, was performed at 26 and 30 cycles of amplification. Results show strong expression of 74P3B3 in the two prostate metastasis to LN specimens and in prostate cancer pool. Expression was also detected in bladder cancer pool, cancer metastasis pool, and vital pool 2 but not in the vital pool 1.

FIG. 16A-16C. Expression of 74P3B3 in normal tissues. Two multiple tissue northern blots (A and B; Clontech) both with 2 μg of mRNA/lane, and a LAPC xenograft blot with 10 μg of total RNA/lane (C) were probed with the 74P3B3 SSH fragment. Size standards in kilobases (kb) are indicated on the side. Results show expression of approximately 7 kB 74P3B3 transcript in prostate but not in the other normal tissues tested. Expression was also detected in LAPC-4AD and LAPC-4AI but not in LAPC-9AD and LAPC-9AI.

FIG. 17. Expression of 74P3B3 in prostate cancer patient specimens. RNA was extracted from normal prostate (NP), pool of 3 prostate cancer patient tumors (T) and their normal adjacent tissues (N). Northern blot with 10 μg of total RNA/lane was probed with 74P3B3 SSH sequence. Size standards in kilobases (kb) are indicated on the side. The results show strong expression of 74P3B3 in normal prostate and in patient prostate cancer specimens.

FIG. 18. Expression of 74P3B3 in patient cancer specimens. Expression of 74P3B3 was assayed in a panel of human cancers (T) and their respective matched normal tissues (N) on RNA dot blots. Upregulated expression of 74P3B3 in tumors compared to normal tissues was observed in prostate, kidney, breast and colon tumors. The expression detected in normal adjacent tissues (isolated from diseased tissues) but not in normal tissues (isolated from healthy donors) may indicate that these tissues are not fully normal and that 74P3B3 may be expressed in early stage tumors.

FIG. 19. Expression of 83P4B8 by RT-PCR. First strand cDNA was prepared from vital pool 1 (liver, lung and kidney), vital pool 2 (pancreas, colon and stomach), prostate cancer pool, bladder cancer pool, kidney cancer pool, colon cancer pool, lung cancer pool, ovary cancer pool, breast cancer pool, and cancer metastasis pool. Normalization was performed by PCR using primers to actin and GAPDH. Semi-quantitative PCR, using primers to 83P4B8, was performed at 30 cycles of amplification. Results show strong expression of 83P4B8 in all cancer pools tested. Very low expression was detected in the vital pools.

FIG. 20A-20C. Expression of 83P4B8 in normal tissues. Two multiple tissue northern blots (A and B; Clontech) both with 2 μg of mRNA/lane, and a LAPC xenograft blot with 10 μg of total RNA/lane (C) were probed with the 83P4B8 SSH fragment. Size standards in kilobases (kb) are indicated on the side. Results show expression of two approximately 4.4 kb 83P4B8 transcripts in testis and to lower level in thymus but not in the other normal tissues tested. Expression was also detected in all 4 LAPC prostate cancer xenografts.

FIG. 21. Expression of 83P4B8 in patient cancer specimens and normal tissues. RNA was extracted from a pool of three prostate cancers (PC), bladder cancers (BC), kidney cancers (KC), colon cancers (CC), lung cancers (LC), ovary cancers (OC), cancer metastasis (Met), pancreas cancers (PaC), as well as from normal prostate (NP), normal bladder (NB), normal kidney (NK), normal colon (NC), normal lung (NL), normal breast (NBr) normal ovary (NO) and normal pancreas (NPa). Northern blot with 10 μg of total RNA/lane was probed with 83P4B8 sequence. Size standards in kilobases (kb) are indicated on the side. Results show expression of 83P4B8 in the bladder cancers and ovary cancers. Expression of 83P4B8 was also detected in prostate cancers, kidney cancers, colon cancers, lung cancers, cancer metastasis and pancreas cancer but not in the normal tissues tested.

FIG. 22. Expression of 83P4B8 in prostate cancer patient specimens. RNA was extracted from normal prostate (NP), prostate cancer patient tumors (T) and their normal adjacent tissues (N). Northern blot with 10 μg of total RNA/lane was probed with 83P4B8 SSH sequence. Size standards in kilobases (kb) are indicated on the side. The results show strong expression of 83P4B8 in the patient prostate cancer specimens.

FIG. 23. Expression of 83P4B8 in colon cancer patient specimens. RNA was extracted from colon cancer cell lines (CL), normal colon (N), colon cancer patient tumors (T) and their normal adjacent tissues (Nat). Northern blots with 10 μg of total RNA were probed with the 83P4B8 SSH fragment. Size standards in kilobases are indicated on the side. Results show strong expression of 83P4B8 in the colon tumor tissues and in all three colon cancer cell lines tested, but not in the normal tissues.

FIG. 24. Expression of 109P1D4 by RT-PCR. First strand cDNA was prepared from vital pool 1 (liver, lung and kidney), vital pool 2 (pancreas, colon and stomach), prostate cancer pool, bladder cancer pool, kidney cancer pool, colon cancer pool, lung cancer pool, ovary cancer pool, breast cancer pool, cancer metastasis pool, and pancreas cancer pool. Normalization was performed by PCR using primers to actin and GAPDH. Semi-quantitative PCR, using primers to 109P1D4, was performed at 30 cycles of amplification. Results show strong expression of 109P1D4 in all cancer pools tested. Very low expression was detected in the vital pools FIGS. 25A and 25B. Expression of 109P1D4 in normal tissues. Two multiple tissue northern blots (Clontech), both with 2 μg of mRNA/lane, were probed with the 109P1D4 SSH fragment. Size standards in kilobases (kb) are indicated on the side. Results show expression of approximately 10 kb 109P1D4 transcript in ovary. Weak expression was also detected in placenta and brain, but not in the other normal tissues tested.

FIG. 26. Expression of 109P1D4 in human cancer cell lines. RNA was extracted from a number of human prostate and bone cancer cell lines. Northern blots with 10 μg of total RNA/lane were probed with the 109P1D4 SSH fragment. Size standards in kilobases (kb) are indicated on the side. Results show expression of 109P1D4 in LAPC-9AD, LAPC-9AI, LNCaP prostate cancer cell lines, and in the bone cancer cell lines, SK-ES-1 and RD-ES.

FIG. 27. Expression of 109P1D4 in patient cancer specimens. Expression of 109P1D4 was assayed in a panel of human cancers (T) and their respective matched normal tissues (N) on RNA dot blots. Upregulated expression of 109P1D4 in tumors compared to normal tissues was observed in uterus, lung and stomach. The expression detected in normal adjacent tissues (isolated from diseased tissues) but not in normal tissues (isolated from healthy donors) may indicate that these tissues are not fully normal and that 109P1D4 may be expressed in early stage tumors.

FIG. 28. Expression of 151P1C7A by RT-PCR. First strand cDNA was prepared from vital pool 1 (liver, lung and kidney), vital pool 2 (pancreas, colon and stomach), LAPC prostate cancer xenograft pool (LAPC-4AD, LAPC-4AI, LAPC-9AD and LAPC-9AI), prostate cancer pool, bladder cancer pool, kidney cancer pool, colon cancer pool, lung cancer pool, and cancer metastasis pool. Normalization was performed by PCR using primers to actin and GAPDH. Semi-quantitative PCR, using primers to 151P1C7A, was performed at 26 and 30 cycles of amplification. Results show strong expression of 151P1C7A in bladder, lung, and metastasis cancer pools tested. Expression was also detected in xenograft, prostate, kidney and colon cancer pools but not in the vital pools.

FIGS. 29A and 29B. Expression of 151P1C7A in normal tissues. Two multiple tissue northern blots (Clontech), both with 2 μg of mRNA/lane, were probed with the 151P1C7A SSH fragment. Size standards in kilobases (kb) are indicated on the side. Results show expression of an approximately 2 kb 151P1C7A transcript in placenta but not in the other normal tissues tested.

FIG. 30. Expression of 151P1C7A in bladder cancer patient specimens. RNA was extracted from bladder cancer cell lines (CL; UM-UC-3, J82, SCaBER), normal bladder (Nb), bladder cancer patient tumors (T) and their normal adjacent tissue (N) isolated from bladder cancer patients. Northern blots with 10 μg of total RNA were probed with the 151P1C7A SSH sequence. Size standards in kilobases are indicated on the side. Results show expression of 151P1C7A in patient bladder cancer tissues, and in all bladder cancer cell lines tested, but not in normal bladder.

FIG. 31. Expression of 151P1C7A in prostate cancer patient specimens. RNA was extracted from normal prostate (NP), prostate cancer patient tumors (T) and their normal adjacent tissues (N). Northern blot with 10 μg of total RNA/lane was probed with 151P1C7A SSH sequence. Size standards in kilobases (kb) are indicated on the side. Results show expression of 151P1C7A in the patient prostate cancer specimens.

FIG. 32. Expression of 151P4E11 by RT-PCR. First strand cDNA was prepared from vital pool 1 (liver, lung and kidney), vital pool 2 (pancreas, colon and stomach), LAPC prostate cancer xenograft pool (LAPC-4AD, LAPC-4AI, LAPC-9AD and LAPC-9AI), prostate cancer pool, bladder cancer pool, colon cancer pool, lung cancer pool, ovary cancer pool, breast cancer pool, and cancer metastasis pool. Normalization was performed by PCR using primers to actin and GAPDH. Semi-quantitative PCR, using primers to 151P4E11, was performed at 26 and 30 cycles of amplification. Results show strong expression of 151P4E11 in all cancer pools tested. Expression was detected in vital pool 2 but not in vital pool 1.

FIG. 33A-33C. Expression of 151P4E11 in normal tissues. Two multiple tissue northern blots (A and B; Clontech) both with 2 μg of mRNA/lane, and a LAPC xenograft blot with 10 μg of total RNA/lane (C) were probed with the 151P4E11 SSH fragment. Size standards in kilobases (kb) are indicated on the side. Results show expression of an approximately 1.2 kb 151P4E11 transcript in prostate, testis, colon and small intestine. Expression was also detected in all the LAPC prostate cancer xenografts LAPC-4AD, LAPC-4AI, and LAPC-9AI, but not in LAPC-9AD.

FIG. 34. Expression of 154P2A8 by RT-PCR. First strand cDNA was prepared from vital pool 1 (liver, lung and kidney), vital pool 2 (pancreas, colon and stomach), prostate cancer pool, bladder cancer pool, kidney cancer pool, colon cancer pool, lung cancer pool, and cancer metastasis pool. Normalization was performed by PCR using primers to actin and GAPDH. Semi-quantitative PCR, using primers to 154P2A8, was performed at 26 and 30 cycles of amplification. Results show strong expression of 154P2A8 in bladder cancer pool and lung cancer pool. Expression was also detected in prostate cancer pool, kidney cancer pool, colon cancer pool, and cancer metastasis pool but not in vital pool 1 and vital pool 2.

FIG. 35. Expression of 156P1D4 by RT-PCR. First strand cDNA was prepared from vital pool 1 (liver, lung and kidney), vital pool 2 (pancreas, colon and stomach), LAPC prostate cancer xenograft pool (LAPC-4AD, LAPC-4AI, LAPC-9AD and LAPC-9AI), prostate cancer pool, bladder cancer pool, kidney cancer pool, colon cancer pool, lung cancer pool, ovary cancer pool, breast cancer pool, and cancer metastasis pool. Normalization was performed by PCR using primers to actin and GAPDH. Semi-quantitative PCR, using primers to 156P1D4, was performed at 26 and 30 cycles of amplification. Results show strong expression of 156P1D4 in kidney cancer pool and vital pool 1. Expression was also detected in xenograft pool, prostate cancer pool, bladder cancer pool, colon cancer pool, lung cancer pool, ovary cancer pool, breast cancer pool, cancer metastasis pool and vital pool 2.

FIG. 36. Expression of 156P1D4 in normal tissues. Two multiple tissue northern blots (Clontech), both with 2 μg of mRNA/lane, were probed with the 156P1D4 SSH fragment. Size standards in kilobases (kb) are indicated on the side. Results show expression of an approximately 2 kb 156P1D4 transcript in kidney and prostate but not in the other normal tissues tested.

FIG. 37. Expression of 156P1D4 in kidney cancer patient specimens. RNA was extracted from normal kidney (Nk), kidney cancer patient tumors (T) and their normal adjacent tissues (N). Northern blots with 10 μg of total RNA were probed with the 156P1D4 SSH fragment. Size standards in kilobases are indicated on the side. Results show strong expression of 156P1D4 in all kidney tumor tissues tested. The expression of 156P1D4 detected in tumor tissues is stronger than in normal tissues.

FIG. 38. Expression of 156P5C12 by RT-PCR. First strand cDNA was prepared from vital pool 1 (liver, lung and kidney), vital pool 2 (pancreas, colon and stomach), LAPC prostate cancer xenograft pool (LAPC -4AD, LAPC-4AI, LAPC-9AD and LAPC-9AI), prostate cancer pool, bladder cancer pool, kidney cancer pool, colon cancer pool, lung cancer pool, ovary cancer pool, breast cancer pool, and cancer metastasis pool. Normalization was performed by PCR using primers to actin and GAPDH. Semi-quantitative PCR, using primers to 156P5C12, was performed at 26 and 30 cycles of amplification. Results show strong expression of 156P5C12 in kidney cancer pool and vital pool 1. Expression was also detected in xenograft pool, prostate cancer pool, bladder cancer pool, colon cancer pool, lung cancer pool, ovary cancer pool, breast cancer pool, cancer metastasis pool and vital pool 2.

FIGS. 39A and 39B. Expression of 156P5C12 in normal tissues. Two multiple tissue northern blots (Clontech), both with 2 μg of mRNA/lane, were probed with the 156P5C12 SSH fragment. Size standards in kilobases (kb) are indicated on the side. Results show expression of an approximately 1.4 kb 156P5C12 transcript in kidney but not in the other normal tissues tested.

FIG. 40. Expression of 156P5C12 in kidney cancer patient specimens. RNA was extracted from kidney cancer cell lines (CL; 769-P, A498, SW839), normal kidney (N), kidney cancer patient tumors (T) and their normal adjacent tissues (NAT). Northern blots with 10 μg of total RNA were probed with the 156P5C12 SSH fragment. Size standards in kilobases are indicated on the side. Results show expression of 156P5C12 in normal tissues, and in some but not all kidney tumor tissues. Expression was absent in the kidney cancer cell lines tested.

FIG. 41. Expression of 159P2B5 by RT-PCR. First strand cDNA was prepared from vital pool 1 (liver, lung and kidney), vital pool 2 (pancreas, colon and stomach), and bladder cancer pool. Normalization was performed by PCR using primers to actin and GAPDH. Semi-quantitative PCR, using primers to 159P2B5, was performed at 26 and 30 cycles of amplification. Results show expression of 159P2B5 in bladder cancer pool tested but not in the vital pools.

FIGS. 42A and 42B. Expression of 159P2B5 in normal tissues. Two multiple tissue northern blots (Clontech), both with 2 μg of mRNA/lane, were probed with the 159P2B5 SSH fragment. Size standards in kilobases (kb) are indicated on the side. Results show very weak expression of an approximately 4.5 kb 159P2B5 transcript in spleen, kidney and small intestine.

FIG. 43. Expression of 159P2B5 in bladder cancer patient specimens. RNA was extracted from bladder cancer cell lines (CL; UM-UC-3, J82, SCaBER), normal bladder (NB), and bladder cancer patient tumors (T) isolated from bladder cancer patients. Northern blots with 10 μg of total RNA were probed with the 159P2B5 SSH sequence. Size standards in kilobases are indicated on the side. Results show expression of 159P2B5 in patient bladder cancer tissues, and in the SCaBER bladder cancer cell line, but not in normal bladder, nor in the other cancer cell lines tested.

FIG. 44. Expression of 161P2B7A by RT-PCR. First strand cDNA was prepared from vital pool 1 (liver, lung and kidney), vital pool 2 (pancreas, colon and stomach), prostate metastasis to lymph node (LN), prostate cancer pool, bladder cancer pool, kidney cancer pool, colon cancer pool, lung cancer pool, ovary cancer pool, breast cancer pool, cancer metastasis pool and pancreas cancer pool. Normalization was performed by PCR using primers to actin and GAPDH. Semi-quantitative PCR, using primers to 161P2B7A, was performed at 26 and 30 cycles of amplification. Results show strong expression of 161P2B7A in lung cancer pool and pancreas cancer pool. Expression was also detected in prostate metastasis to LN, prostate cancer pool, bladder cancer pool, kidney cancer pool, colon cancer pool, ovary cancer pool, breast cancer pool, and cancer metastasis pool. Very low expression was observed in vital pool 2 but not in vital pool 1.

FIGS. 45A and 45B. Expression of 161P2B7A in normal tissues. Two multiple tissue northern blots (Clontech), both with 2 μg of mRNA/lane, were probed with the 161P2B7A SSH fragment. Size standards in kilobases (kb) are indicated on the side. Results show very low expression of 161P2B7A in testis but not in the other normal tissues tested.

FIG. 46. Expression of 161P2B7A in Multiple Normal Tissues. An mRNA dot blot containing 76 different samples from human tissues was analyzed using a 161P2B7A SSH probe. Expression was not detected in any of the 76 normal tissues tested. The positive genomic DNA control showed very strong signal confirming the validity of the experiment.

FIG. 47. Expression of 161P2B7A in kidney cancer patient specimens. RNA was extracted from normal kidney (Nk), kidney cancer patient tumors (T) and their normal adjacent tissues (N) isolated from kidney cancer patients. Northern blots with 10 μg of total RNA were probed with the 161P2B7A SSH fragment. Size standards in kilobases are indicated on the side. Results show expression of two 161P2B7A transcripts, approximately 1.2 and 7 kb, in kidney cancer specimens but not in normal kidney.

FIG. 48. Expression of 161P2B7A in lung cancer patient specimens. RNA was extracted from lung cancer cell lines (CL), normal lung, lung tumors (T), and their normal adjacent tissues (NAT) isolated from lung cancer patients. Northern blot with 10 μg of total RNA/lane was probed with the 161P2B7A fragment. Size standards in kilobases (kb) are indicated on the side. The results show expression of 161P2B7A in the lung tumors, but not in normal lung tissues. Expression was also detected in the lung cancer cell lines CALU-1, A427 and NCI-146 but not in the small cell lung cancer cell line NCI-H82.

FIG. 49. Expression of 161P2B7A in pancreas and ovary cancer patient specimens. RNA was extracted from normal pancreas (NPa), pancreas cancer (PC), normal ovary (NO), and ovary cancer patient specimen (OC). Northern blot with 10 μg of total RNA/lane was probed with the 161P2B7A fragment. Size standards in kilobases (kb) are indicated on the side. The results show expression of 161P2B7A in the pancreas and ovary cancer patient specimens, but not in the normal tissues.

FIG. 50. Expression of 179P3G7 by RT-PCR. First strand cDNA was prepared from vital pool 1 (liver, lung and kidney), vital pool 2 (pancreas, colon and stomach), bladder cancer pool, kidney cancer pool, lung cancer pool, breast cancer pool, cancer metastasis pool, pancreas cancer pool and pancreas cancer pool. Normalization was performed by PCR using primers to actin and GAPDH. Semi-quantitative PCR, using primers to 179P3G7, was performed at 26 and 30 cycles of amplification. Results show strong expression of 179P3G7 in kidney cancer pool and breast cancer pool. Expression was also detected in bladder cancer pool, lung cancer pool, cancer metastasis pool, pancreas cancer pool and prostate metastasis to LN, and vital pool 1, but not in vital pool 2.

FIGS. 51A and 51B. Expression of 179P3G7 in normal tissues. Two multiple tissue northern blots (Clontech), both with 2 μg of mRNA/lane, were probed with the 179P3G7 SSH fragment. Size standards in kilobases (kb) are indicated on the side. Results show expression of 179P3G7 strongly in skeletal muscle, and weakly in kidney, liver and heart but not in the other normal tissues tested.

FIG. 52. Expression of 179P3G7 in kidney cancer patient specimens. RNA was extracted from normal kidney (Nk), kidney cancer patient tumors (T) and their normal adjacent tissues (N) isolated from kidney cancer patients. Northern blots with 10 μg of total RNA were probed with the 179P3G7 SSH fragment. Size standards in kilobases are indicated on the side. Results show expression of 179P3G7 in kidney cancer specimens. Expression of 179P3G7 is stronger in kidney tumors compared to normal kidney tissues.

FIG. 53. Expression of 184P3C10B by RT-PCR. First strand cDNA was prepared from vital pool 1 (liver, lung and kidney), vital pool 2 (pancreas, colon and stomach), LAPC prostate cancer xenograft pool (LAPC-4AD, LAPC-4AI, LAPC-9AD and LAPC-9AI), prostate cancer pool, bladder cancer pool, kidney cancer pool, colon cancer pool, lung cancer pool, ovary cancer pool, and cancer metastasis pool. Normalization was performed by PCR using primers to actin and GAPDH. Semi-quantitative PCR, using primers to 184P3C10B, was performed at 26 and 30 cycles of amplification. Results show expression of 184P3C10B in xenograft pool, prostate cancer pool, bladder cancer pool, kidney cancer pool, colon cancer pool, lung cancer pool, ovary cancer pool, and cancer metastasis pool. Expression was also detected in vital pool 2 but at a much lower level in vital pool 1.

FIG. 54. Expression of 184P3C10B in normal tissues. Two multiple tissue northern blots (Clontech), both with 2 μg of mRNA/lane, were probed with the 184P3C10B SSH fragment. Size standards in kilobases (kb) are indicated on the side. Results show expression of approximately 2.4 and 5 kb 184P3C10B transcripts in placenta and to lower level in colon and small intestine, but not in the other normal tissues tested.

FIG. 55. Expression of 184P3C10B in bladder cancer patient specimens. RNA was extracted from bladder cancer cell lines (CL; UM-UC-3, J82, SCaBER), normal bladder (Nb), bladder cancer patient tumors (T) and their normal adjacent tissue (N) isolated from bladder cancer patients. Northern blots with 10 μg of total RNA were probed with the 184P3C10B SSH sequence. Size standards in kilobases are indicated on the side. Results show expression of 184P3C10B in patient bladder cancer tissues, and in the bladder cancer cell line SCaBER, but not in normal bladder nor in the other bladder cancer cell lines tested.

FIG. 56. Expression of 184P3G10 by RT-PCR. First strand cDNA was prepared from vital pool 1 (liver, lung and kidney), vital pool 2 (pancreas, colon and stomach), LAPC prostate cancer xenograft pool (LAPC-4AD, LAPC-4AI, LAPC-9AD and LAPC-9AI), bladder cancer pool, kidney cancer pool, colon cancer pool, and lung cancer pool. Normalization was performed by PCR using primers to actin and GAPDH. Semi-quantitative PCR, using primers to 184P3G10, was performed at 26 and 30 cycles of amplification. Results show strong expression of 184P3G10 in bladder cancer pool, kidney cancer pool, and colon cancer pool. Expression was also detected in xenograft pool, lung cancer pool, vital pool 2 but not in vital pool 1.

FIGS. 57A and 57B. Expression of 184P3G10 in normal tissues. Two multiple tissue northern blots (Clontech) both with 2 μg of mRNA/lane, were probed with the 184P3G10 SSH fragment. Size standards in kilobases (kb) are indicated on the side. Results show expression of two approximately 4.4 kb 184P3G10 transcripts in colon and small intestine, but not in the other normal tissues tested.

FIG. 58. Expression of 184P3G10 in patient cancer specimens and normal tissues. RNA was extracted from a pool of three bladder cancers, colon cancers, lung cancers, breast cancers, ovary cancers, cancer metastasis, as well as from normal prostate (NP), normal bladder (NB), and normal kidney (NK). Northern blot with 10 μg of total RNA/lane was probed with 184P3G10 sequence. Size standards in kilobases (kb) are indicated on the side. Results show strong expression of 184P3G10 in the bladder cancers, colon cancers and ovary cancers. Expression of 184P3G10 was also detected in lung cancers, breast cancers, and cancer metastasis but not in the normal tissues tested.

FIG. 59. Expression of 184P3G10 in bladder cancer patient specimens. RNA was extracted from bladder cancer cell lines (CL; UM-UC-3, J82, SCaBER), normal bladder (N), bladder cancer patient tumors (T) and their normal adjacent tissue (Nat) isolated from bladder cancer patients. Northern blots with 10 μg of total RNA were probed with the 184P3G10 SSH sequence. Size standards in kilobases are indicated on the side. Results show expression of 184P3G10 in patient bladder cancer tissues, but not in normal bladder nor in the bladder cancer cell lines tested.

FIG. 60. Expression of 185P2C9 by RT-PCR. First strand cDNA was prepared from vital pool 1 (liver, lung and kidney), vital pool 2 (pancreas, colon and stomach), prostate metastasis to lymph node (LN), prostate cancer pool, bladder cancer pool, kidney cancer pool, colon cancer pool, lung cancer pool, ovary cancer pool, breast cancer pool, cancer metastasis pool and pancreas cancer pool. Normalization was performed by PCR using primers to actin and GAPDH. Semi-quantitative PCR, using primers to 185P2C9, was performed at 30 cycles of amplification. Results show strong expression of 185P2C9 in bladder cancer pool, colon cancer pool, lung cancer pool, ovary cancer pool and pancreas cancer pool. Expression was also detected in prostate metastasis to LN, prostate cancer pool, kidney cancer pool, breast cancer pool, cancer metastasis pool, vital pool 2 but not in vital pool 1.

FIG. 61. Expression of 185P2C9 in normal tissues. Two multiple tissue northern blots (Clontech), both with 2 μg of mRNA/lane, were probed with the 185P2C9 SSH fragment. Size standards in kilobases (kb) are indicated on the side. Results show expression of and approximately 8.5 kb 185P2C9 transcript in testis and brain, but not in the other normal tissues tested.

FIG. 62. Expression of 185P2C9 in bladder cancer patient specimens. RNA was extracted from bladder cancer cell lines (CL; UM-UC-3, 382, SCaBER), normal bladder (Nb), bladder cancer patient tumors (T) and their normal adjacent tissue (N) isolated from bladder cancer patients. Northern blots with 10 μg of total RNA were probed with the 185P2C9 SSH sequence. Size standards in kilobases are indicated on the side. Results show expression of 185P2C9 in bladder cancer patient tissues, and in the bladder cancer cell lines tested. Expression of 185P2C9 is significantly stronger in bladder tumor tissues compared to normal tissues.

FIG. 63. Expression of 185P2C9 in kidney cancer patient specimens. RNA was extracted from kidney cancer cell lines (CL; 769-P, A498, Caki-1), normal kidney (N), kidney cancer patient tumors (T) and their normal adjacent tissues (NAT) isolated from kidney cancer patients. Northern blots with 10 μg of total RNA were probed with the 185P2C9 SSH fragment. Size standards in kilobases are indicated on the side. Results show expression of 185P2C9 in kidney cancer specimens and kidney cancer cell lines, but not in normal kidney.

FIG. 64. Expression of 186P1H9 by RT-PCR. First strand cDNA was prepared from vital pool 1 (liver, lung and kidney), vital pool 2 (pancreas, colon and stomach), bladder cancer pool, kidney cancer pool, colon cancer pool, lung cancer pool, ovary cancer pool, cancer metastasis pool, and pancreas cancer pool. Normalization was performed by PCR using primers to actin and GAPDH. Semi-quantitative PCR, using primers to 186P1H9, was performed at 26 and 30 cycles of amplification. Results show strong expression of 186P1H9 in kidney cancer pool, colon cancer pool, ovary cancer pool, cancer metastasis pool, and pancreas cancer pool. Expression was also detected in bladder cancer pool, lung cancer pool, vital pool 2 but not in vital pool 1.

FIG. 65. Expression of 186P1H9 in normal tissues. Two multiple tissue northern blots (Clontech) both with 2 μg of mRNA/lane, were probed with the 186P1H9 SSH fragment. Size standards in kilobases (kb) are indicated on the side.

Results show expression of an approximately 2.6 kb 186P1H9 transcript in testis, spleen, pancreas and brain. Lower expression is also detected in heart, skeletal muscle, prostate, colon and small intestine.

FIG. 66. Expression of 186P1H9 in patient cancer specimens and normal tissues. RNA was extracted from a pool of three kidney cancers (KC), ovary cancers (OC), cancer metastasis (Met), pancreas cancers (PaC), as well as from normal prostate (NP), normal bladder (NB), and normal kidney (NK), normal colon (NC), normal lung (NL), normal breast (NBr), normal ovary (NO), and normal pancreas (NPa). Northern blot with 10 μg of total RNA/lane was probed with 186P1H9 sequence. Size standards in kilobases (kb) are indicated on the side. Results show strong expression of 186P1H9 in the bladder cancers, ovary cancers, cancer metastasis and pancreas cancers, but not in normal tissues. Expression of 186P1H9 is significantly stronger in patient cancer tissues compared to normal tissues.

FIG. 67. Expression of 186P1H9 in kidney cancer patient specimens. RNA was extracted from kidney cancer cell lines (CL; 769-P, A498, Caki-1), normal kidney (N), kidney cancer patient tumors (T) and their normal adjacent tissues (NAT) isolated from kidney cancer patients. Northern blots with 10 μg of total RNA were probed with the 186P1H9 SSH fragment. Size standards in kilobases are indicated on the side. Results show strong expression of 186P1H9 in kidney cancer patient specimens, but not in normal kidney, nor in the kidney cancer cell lines.

FIG. 68. Expression of 186P1H9 in ovarian and testicular cancer patient specimens. RNA was extracted from normal ovary (NO), ovary cancer patient specimens (P1, P2, P3), normal testis (NTe), and testis cancer patient specimens (P4, P5, P6). Northern blot with 10 μg of total RNA/lane was probed with the 186P1H9 SSH fragment. Size standards in kilobases (kb) are indicated on the side. The results show strong expression of 186P1H9 in the ovary cancer patient specimens, but not in the normal ovary. Expression was also detected in normal and in testis cancer specimens.

FIG. 69. Expression of 187P3F2 by RT-PCR. First strand cDNA was prepared from vital pool 1 (liver, lung and kidney), vital pool 2 (pancreas, colon and stomach), kidney cancer pool, and pancreas cancer pool. Normalization was performed by PCR using primers to actin and GAPDH. Semi-quantitative PCR, using primers to 187P3F2, was performed at 26 and 30 cycles of amplification. Results show strong expression of 187P3F2 in kidney cancer pool, pancreas cancer pool and vital pool 1, but not in vital pool 2.

FIG. 70. Expression of 187P3F2 in normal tissues. Two multiple tissue northern blots (Clontech) both with 2 μg of mRNA/lane, were probed with the 187P3F2 SSH fragment. Size standards in kilobases (kb) are indicated on the side. Results show expression of an 4.5 kb 187P3F2 transcript in kidney and brain, but not in the other tissues tested.

FIG. 71. Expression of 187P3F2 in patient cancer specimens and normal tissues. RNA was extracted from a pool of three kidney cancers (KC), pancreas cancers (PaC), as well as from normal prostate (NP), normal bladder (NB), and normal kidney (NK), normal colon (NC), normal lung (NL), normal breast (NBr), normal ovary (NO), and normal pancreas (NPa). Northern blot with 10 μg of total RNA/lane was probed with 187P3F2 sequence. Size standards in kilobases (kb) are indicated on the side. Results show strong expression of 187P3F2 in kidney cancers, pancreas cancers, and normal kidney, but not in the other normal tissues.

FIG. 72. Expression of 187P3F2 in pancreas cancer patient specimens. RNA was extracted from pancreas cancer cell lines (CL), normal pancreas (N), and pancreas tumor tissues (T) isolated from pancreatic cancer patients. Northern blot with 10 μg of total RNA/lane was probed with the 187P3F2 SSH fragment. Size standards in kilobases (kb) are indicated on the side. The results show strong expression of 187P3F2 in the pancreas cancer specimens, but not in normal pancreas nor in the cancer cell lines tested.

FIG. 73. Expression of 192P2G7 by RT-PCR. First strand cDNA was prepared from vital pool 1 (liver, lung and kidney), vital pool 2 (pancreas, colon and stomach), prostate cancer pool, bladder cancer pool, kidney cancer pool, lung cancer pool, ovary cancer pool, breast cancer pool, cancer metastasis pool, pancreas cancer pool, and prostate metastasis to lymph node (LN). Normalization was performed by PCR using primers to actin and GAPDH. Semi-quantitative PCR, using primers to 186P1H9, was performed at 26 and 30 cycles of amplification. Results show strong expression of 186P1H9 in pancreas cancer pool and prostate metastasis to LN. Expression was also detected in prostate cancer pool, bladder cancer pool, kidney cancer pool, lung cancer pool, ovary cancer pool, breast cancer pool, cancer metastasis pool, vital pool 2 but not in vital pool 1.

FIG. 74. Expression of 185P3C2 by RT-PCR. First strand cDNA was prepared from vital pool 1 (liver, lung and kidney), vital pool 2 (pancreas, colon and stomach), and bladder cancer pool. Normalization was performed by PCR using primers to actin and GAPDH. Semi-quantitative PCR, using primers to 185P3C2, was performed at 26 and 30 cycles of amplification. Results show strong expression of 185P3C2 in bladder cancer pool. Low level expression was detected in vital pool 2, but not in vital pool 1.

DETAILED DESCRIPTION OF THE INVENTION

Outline of Sections

I.) Definitions
II.) Polynucleotides of the Invention
II.A.) Uses Polynucleotides of the Invention
II.A.1.) Monitoring of Genetic Abnormalities
II.A.2.) Antisense Embodiments
II.A.3.) Primers and Primer Pairs
II.A.4.) Isolation of Nucleic Acid Molecules that Encode Proteins of the Invention
II.A.5.) Recombinant Nucleic Acid Molecules and Host-Vector Systems
III.) Proteins of the Invention
III.A.) Motif-bearing Protein Embodiments
III.B.) Expression of FIG. 2-*related* Proteins
III.C.) Modifications of FIG. 2-*related* Proteins
III.D.) Uses of FIG. 2-*related* Proteins
IV.) Antibodies of the Invention
V.) Cellular Immune Responses of the Invention
VI.) Transgenic Animals of the Invention
VII.) Methods for the Detection of a Gene or Protein of the Invention
VIII.) Methods for Monitoring the Status of Genes and Proteins of the Invention
IX.) Identification of Molecules That Interact With the Proteins of FIG. 2
X.) Therapeutic Methods and Compositions
X.A.) Anti-Cancer Vaccines
X.B.) A Protein of FIG. 2 as a Target for Antibody-Based Therapy
X.C.) A Protein of FIG. 2 as a Target for Cellular Immune Responses
X.C.1. Minigene Vaccines
X.C.2. Combinations of CTL Peptides with Helper Peptides X.C.3. Combinations of CTL Peptides with T Cell Priming Agents X.C.4. Vaccine Compositions Comprising DC Pulsed with CTL and/or HTL Peptides X.D.) Adoptive Immunotherapy X.E.) Administration of Vaccines for Therapeutic or Prophylactic Purposes XI.) Diagnostic and Prognostic Embodiments of the Invention XII.) Inhibition of the Function of a Protein of the Invention XII.A.) Inhibition of a Protein of FIG. 2 with Intracellular Antibodies XII.B.) Inhibition of a Protein of FIG. 2 with Recombinant Proteins XII.C.) Inhibition of Transcription or Translation in Accordance with the Invention XII.D.) General Considerations for Therapeutic Strategies

XII.) KITS

I.) Definitions:

Unless otherwise defined, all terms of art, notations and other scientific terms or terminology used herein are intended to have the meanings commonly understood by those of skill in the art to which this invention pertains. In some cases, terms with commonly understood meanings are defined herein for clarity and/or for ready reference, and the inclusion of such definitions herein should not necessarily be construed to represent a substantial difference over what is generally understood in the art. Many of the techniques and procedures described or referenced herein are well understood and commonly employed using conventional methodology by those skilled in the art, such as, for example, the widely utilized molecular cloning methodologies described in Sambrook et al., Molecular Cloning: A Laboratory Manual 2nd. edition (1989) Cold Spring Harbor Laboratory Press, Cold Spring Harbor, N.Y. As appropriate, procedures involving the use of commercially available kits and reagents are generally carried out in accordance with manufacturer defined protocols and/or parameters unless otherwise noted.

The terms "advanced prostate cancer", "locally advanced prostate cancer", "advanced disease" and "locally advanced disease" mean prostate cancers that have extended through the prostate capsule, and are meant to include stage C disease under the American Urological Association (AUA) system, stage C1-C2 disease under the Whitmore-Jewett system, and stage T3-T4 and N+ disease under the TNM (tumor, node, metastasis) system. In general, surgery is not recommended for patients with locally advanced disease, and these patients have substantially less favorable outcomes compared to patients having clinically localized (organ-confined) prostate cancer. Locally advanced disease is clinically identified by palpable evidence of induration beyond the lateral border of the prostate, or asymmetry or induration above the prostate base. Locally advanced prostate cancer is presently diagnosed pathologically following radical prostatectomy if the tumor invades or penetrates the prostatic capsule, extends into the surgical margin, or invades the seminal vesicles.

"Altering the native glycosylation pattern" is intended for purposes herein to mean deleting one or more carbohydrate moieties found in native sequence of the genes set forth in FIG. 2 (either by removing the underlying glycosylation site or by deleting the glycosylation by chemical and/or enzymatic means), and/or adding one or more glycosylation sites that are not present in the native sequence of a protein set forth in FIG. 2. In addition, the phrase includes qualitative changes in the glycosylation of the native proteins, involving a change in the nature and proportions of the various carbohydrate moieties present.

The term "analog" refers to a molecule which is structurally similar or shares similar or corresponding attributes with another molecule (e.g. a protein of FIG. 2). For example an analog of a protein of FIG. 2 can be specifically bound by an antibody or T cell that specifically binds to the respective protein of FIG. 2.

The term "antibody" is used in the broadest sense. Therefore an "antibody" can be naturally occurring or man-made such as monoclonal antibodies produced by conventional hybridoma technology. Antibodies of the invention comprise monoclonal and polyclonal antibodies as well as fragments containing the antigen-binding domain and/or one or more complementarity determining regions of these antibodies that specifically bind a protein of FIG. 2.

An "antibody fragment" is defined as at least a portion of the variable region of the immunoglobulin molecule that binds to its target, i.e., the antigen-binding region. In one embodiment it specifically covers single antibodies and clones thereof (including agonist, antagonist and neutralizing antibodies) and antibody compositions with polyepitopic specificity.

The term "codon optimized sequences" refers to nucleotide sequences that have been optimized for a particular host species by replacing any codons having a usage frequency of less than about 20%. Nucleotide sequences that have been optimized for expression in a given host species by elimination of spurious polyadenylation sequences, elimination of exon/intron splicing signals, elimination of transposon-like repeats and/or optimization of GC content in addition to codon optimization are referred to herein as an "expression enhanced sequences."

The term "cytotoxic agent" refers to a substance that inhibits or prevents the expression activity of cells, function of cells and/or causes destruction of cells. The term is intended to include radioactive isotopes chemotherapeutic agents, and toxins such as small molecule toxins or enzymatically active toxins of bacterial, fungal, plant or animal origin, including fragments and/or variants thereof. Examples of cytotoxic agents include, but are not limited to maytansinoids, yttrium, bismuth, ricin, ricin A-chain, doxorubicin, daunorubicin, taxol, ethidium bromide, mitomycin, etoposide, tenoposide, vincristine, vinblastine, colchicine, dihydroxy anthracin dione, actinomycin, diphtheria toxin, *Pseudomonas* exotoxin (PE) A, PE40, abrin, abrin A chain, modeccin A chain, alpha-sarcin, gelonin, mitogellin, retstrictocin, phenomycin, enomycin, curicin, crotin, calicheamicin, sapaonaria officinalis inhibitor, and glucocorticoid and other chemotherapeutic agents, as well as radioisotopes such as $At^{211}$, $I^{131}$, $I^{125}$, $Y^{90}$, $Re^{186}$, $Re^{188}$, $Sm^{153}$, $Bi^{212}$, $P^{32}$ and radioactive isotopes of Lu. Antibodies may also be conjugated to an anti-cancer pro-drug activating enzyme capable of converting the pro-drug to its active form.

The term "homolog" refers to a molecule which exhibits homology to another molecule, by for example, having sequences of chemical residues that are the same or similar at corresponding positions.

"Human Leukocyte Antigen" or "HLA" is a human class I or class II Major Histocompatibility Complex (MHC) protein (see, e.g., Stites, et al., IMMUNOLOGY, $8^{TH}$ ED., Lange Publishing, Los Altos, Calif. (1994).

The terms "hybridize", "hybridizing", "hybridizes" and the like, used in the context of polynucleotides, are meant to refer to conventional hybridization conditions, preferably such as hybridization in 50% formamide/6×SSC/0.1% SDS/

100 μg/ml ssDNA, in which temperatures for hybridization are above 37 degrees C. and temperatures for washing in 0.1×SSC/0.1% SDS are above 55 degrees C.

The phrases "isolated" or "biologically pure" refer to material which is substantially or essentially free from components which normally accompany the material as it is found in its native state. Thus, isolated peptides in accordance with the invention preferably do not contain materials normally associated with the peptides in their in situ environment. For example, a polynucleotide is said to be "isolated" when it is substantially separated from contaminant polynucleotides that correspond or are complementary to genes other than the genes of FIG. 2 or that encode polypeptides other than proteins of FIG. 2 product or fragments thereof. A skilled artisan can readily employ nucleic acid isolation procedures to obtain an isolated polynucleotide. A protein is said to be "isolated," for example, when physical, mechanical or chemical methods are employed to remove a protein of FIG. 2 from cellular constituents that are normally associated with the protein. A skilled artisan can readily employ standard purification methods to obtain an isolated FIG. 2 protein. Alternatively, an isolated protein can be prepared by chemical means.

The term "mammal" refers to any organism classified as a mammal, including mice, rats, rabbits, dogs, cats, cows, horses and humans. In one embodiment of the invention, the mammal is a mouse. In another embodiment of the invention, the mammal is a human.

The terms "metastatic prostate cancer" and "metastatic disease" mean prostate cancers that have spread to regional lymph nodes or to distant sites, and are meant to include stage D disease under the AUA system and stage TxNxM+ under the TNM system. As is the case with locally advanced prostate cancer, surgery is generally not indicated for patients with metastatic disease, and hormonal (androgen ablation) therapy is a preferred treatment modality. Patients with metastatic prostate cancer eventually develop an androgen-refractory state within 12 to 18 months of treatment initiation. Approximately half of these androgen-refractory patients die within 6 months after developing that status. The most common site for prostate cancer metastasis is bone. Prostate cancer bone metastases are often osteoblastic rather than osteolytic (i.e., resulting in net bone formation). Bone metastases are found most frequently in the spine, followed by the femur, pelvis, rib cage, skull and humerus. Other common sites for metastasis include lymph nodes, lung, liver and brain. Metastatic prostate cancer is typically diagnosed by open or laparoscopic pelvic lymphadenectomy, whole body radionuclide scans, skeletal radiography, and/or bone lesion biopsy.

The term "monoclonal antibody" refers to an antibody obtained from a population of substantially homogeneous antibodies, i.e., the antibodies comprising the population are identical except for possible naturally occurring mutations that are present in minor amounts.

A "motif", as in biological motif of a FIG. 2-*related* protein, refers to any pattern of amino acids forming part of the primary sequence of a protein, that is associated with a particular function (e.g. protein-protein interaction, protein-DNA interaction, etc) or modification (e.g. that is phosphorylated, glycosylated or amidated), or localization (e.g. secretory sequence, nuclear localization sequence, etc.) or a sequence that is correlated with being immunogenic, either humorally or cellularly. A motif can be either contiguous or capable of being aligned to certain positions that are generally correlated with a certain function or property. In the context of HLA motifs, "motif" refers to the pattern of residues in a peptide of defined length, usually a peptide of from about 8 to about 13 amino acids for a class I HLA motif and from about 6 to about 25 amino acids for a class II HLA motif, which is recognized by a particular HLA molecule. Peptide motifs for HLA binding are typically different for each protein encoded by each human HLA allele and differ in the pattern of the primary and secondary anchor residues.

A "pharmaceutical excipient" comprises a material such as an adjuvant, a carrier, pH-adjusting and buffering agents, tonicity adjusting agents, wetting agents, preservative, and the like.

"Pharmaceutically acceptable" refers to a non-toxic, inert, and/or composition that is physiologically compatible with humans or other mammals.

The term "polynucleotide" means a polymeric form of nucleotides of at least 10 bases or base pairs in length, either ribonucleotides or deoxynucleotides or a modified form of either type of nucleotide, and is meant to include single and double stranded forms of DNA and/or RNA. In the art, this term if often used interchangeably with "oligonucleotide". A polynucleotide can comprise a nucleotide sequence disclosed herein wherein thymine (T), as shown for example in FIG. 2, can also be uracil (U); this definition pertains to the differences between the chemical structures of DNA and RNA, in particular the observation that one of the four major bases in RNA is uracil (U) instead of thymine (T).

The term "polypeptide" means a polymer of at least about 4, 5, 6, 7, or 8 amino acids. Throughout the specification, standard three letter or single letter designations for amino acids are used. In the art, this term is often used interchangeably with "peptide" or "protein".

An HLA "primary anchor residue" is an amino acid at a specific position along a peptide sequence which is understood to provide a contact point between the immunogenic peptide and the HLA molecule. One to three, usually two, primary anchor residues within a peptide of defined length generally defines a "motif" for an immunogenic peptide. These residues are understood to fit in close contact with peptide binding groove of an HLA molecule, with their side chains buried in specific pockets of the binding groove. In one embodiment, for example, the primary anchor residues for an HLA class I molecule are located at position 2 (from the amino terminal position) and at the carboxyl terminal position of a 8, 9, 10, 11, or 12 residue peptide epitope in accordance with the invention. In another embodiment, for example, the primary anchor residues of a peptide that will bind an HLA class II molecule are spaced relative to each other, rather than to the termini of a peptide, where the peptide is generally of at least 9 amino acids in length. The primary anchor positions for each motif and supermotif are set forth in Table IV. For example, analog peptides can be created by altering the presence or absence of particular residues in the primary and/or secondary anchor positions shown in Table IV. Such analogs are used to modulate the binding affinity and/or population coverage of a peptide comprising a particular HLA motif or supermotif A "recombinant" DNA or RNA molecule is a DNA or RNA molecule that has been subjected to molecular manipulation in vitro.

Non-limiting examples of small molecules include compounds that bind or interact with the proteins of FIG. 2; ligands including hormones, neuropeptides, chemokines, odorants, phospholipids, and functional equivalents thereof that bind and preferably inhibit function of a FIG. 2 protein. Such non-limiting small molecules preferably have a molecular weight of less than about 10 kDa, more preferably below about 9, about 8, about 7, about 6, about 5 or about 4 kDa. In certain embodiments, small molecules physically associate with, or bind, a FIG. 2 protein; and are not found in naturally occurring metabolic pathways; and/or are more soluble in aqueous than non-aqueous solutions "Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured nucleic acid sequences to reanneal when complementary strands are present in an environment below their melting temperature. The higher the degree of desired homology between the probe and hybridizable sequence, the higher the relative temperature that can be used. As a result, it follows that higher relative temperatures would tend to make the reaction conditions more stringent, while lower temperatures less so. For additional details and explanation of stringency of hybridization reactions, see Ausubel et al., Current Protocols in Molecular Biology, Wiley Interscience Publishers, (1995).

"Stringent conditions" or "high stringency conditions", as defined herein, are identified by, but not limited to, those that: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5× Denhardt's solution, sonicated salmon sperm DNA (50 μg/ml), 0.1% SDS, and 10% dextran sulfate at 42° C., with washes at 42° C. in 0.2×SSC (sodium chloride/sodium. citrate) and 50% formamide at 55° C., followed by a high-stringency wash consisting of 0.1×SSC containing EDTA at 55° C. "Moderately stringent conditions" are described by, but not limited to, those in Sambrook et al., Molecular Cloning: A Laboratory Manual, New York: Cold Spring Harbor Press, 1989, and include the use of washing solution and hybridization conditions (e.g., temperature, ionic strength and % SDS) less stringent than those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5× Denhardt's solution, 10% dextran sulfate, and 20 mg/mL denatured sheared salmon sperm DNA, followed by washing the filters in 1×SSC at about 37-50° C. The skilled artisan will recognize how to adjust the temperature, ionic strength, etc. as necessary to accommodate factors such as probe length and the like.

An HLA "supermotif" is a peptide binding specificity shared by HLA molecules encoded by two or more HLA alleles.

As used herein "to treat" or "therapeutic" and grammatically related terms, refer to any improvement of any consequence of disease, such as prolonged survival, less morbidity, and/or a lessening of side effects which are the byproducts of an alternative therapeutic modality; full eradication of disease is not required.

A "transgenic animal" (e.g., a mouse or rat) is an animal having cells that contain a transgene, which transgene was introduced into the animal or an ancestor of the animal at a prenatal, e.g., an embryonic stage. A "transgene" is a DNA that is integrated into the genome of a cell from which a transgenic animal develops.

As used herein, an HLA or cellular immune response "vaccine" is a composition that contains or encodes one or more peptides of the invention. There are numerous embodiments of such vaccines, such as a cocktail of one or more individual peptides; one or more peptides of the invention comprised by a polyepitopic peptide; or nucleic acids that encode such individual peptides or polypeptides, erg., a minigene that encodes a polyepitopic peptide. The "one or more peptides" can include any whole unit integer from 1-150 or more, e.g., at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, 100, 105, 110, 115, 120, 125, 130, 135, 140, 145, or 150 or more peptides of the invention. The peptides or polypeptides can optionally be modified, such as by lipidation, addition of targeting or other sequences. HLA class I peptides of the invention can be admixed with, or linked to, HLA class II peptides, to facilitate activation of both cytotoxic T lymphocytes and helper T lymphocytes. HLA vaccines can also comprise peptide-pulsed antigen presenting cells, e.g., dendritic cells.

The term "variant" refers to a molecule that exhibits a variation from a described type or norm, such as a protein that has one or more different amino acid residues in the corresponding position(s) of a specifically described protein (e.g. a protein of FIG. 2 protein shown in FIG. 2 or FIG. 3. An analog is an example of a variant protein. Splice isoforms and single nucleotides polymorphisms (SNPs) are further examples of variants.

The "genes of FIG. 2-*related* proteins" of the invention include those specifically identified herein, as well as allelic variants, conservative substitution variants, analogs and homologs that can be isolated/generated and characterized without undue experimentation following the methods outlined herein or readily available in the art. Fusion proteins that combine parts of different genes set forth in FIG. 2 proteins of the invention or fragments thereof, as well as fusion proteins of a gene of FIG. 2 protein and a heterologous polypeptide are also included. Such genes of FIG. 2 proteins are collectively referred to as the genes of FIG. 2-*related* proteins, the proteins of the invention, or proteins of FIG. 2. The term "genes of FIG. 2-*related* protein" refers to a polypeptide fragment or a FIG. 2 protein sequence of 4, 5, 6, 7, 8, 9, 10, 11, 12, 13, 14, 15, 16, 17, 18, 19, 20, 21, 22, 23, 24, 25, or more than 25 amino acids; or, at least 30, 35, 40, 45, 50, 55, 60, 65, 70, 80, 85, 90, 95, 100 or more than 100 amino acids. In certain cases the phrase "corresponding to" or "respective" is used instead of the term "-related."

II.) Polynucleotides of the Invention

One aspect of the invention provides polynucleotides corresponding or complementary to all or part of: a gene of FIG. 2; gene of FIG. 2-*related* mRNA, a coding sequence of a gene of FIG. 2, an open reading frame of a gene of FIG. 2, each of the foregoing preferably in isolated form. Polynucleotides of the invention include polynucleotides encoding FIG. 2-*related* proteins and fragments thereof, DNA, RNA, DNA/RNA hybrid, and related molecules, polynucleotides or oligonucleotides complementary to a FIG. 2 gene or mRNA sequence or a part thereof, and polynucleotides or oligonucleotides that hybridize to a FIG. 2 gene, mRNA, or to a FIG. 2 encoding polynucleotide (collectively, "FIG. 2 polynucleotides"). In all instances when referred to in this section, T can also be U in FIG. 2.

Figure 5C:
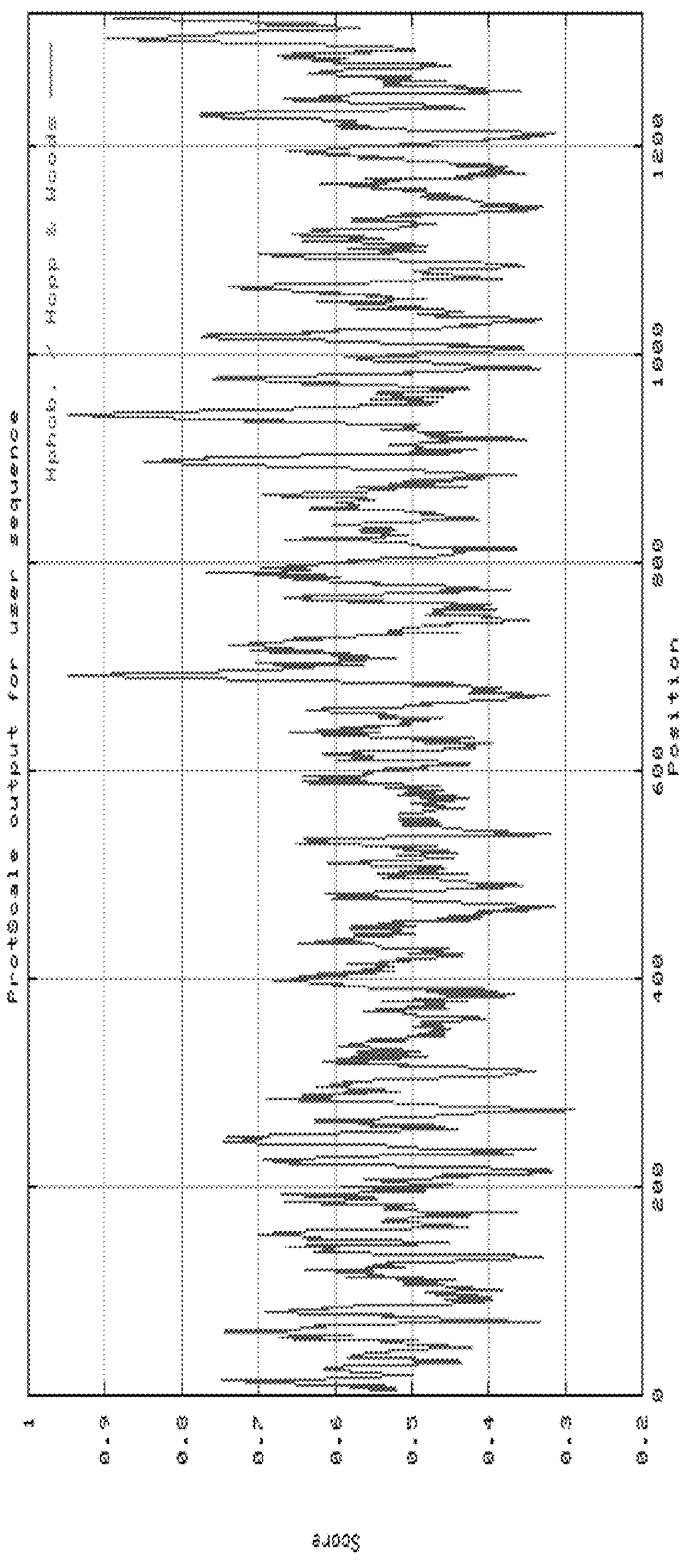
Figure 5D:
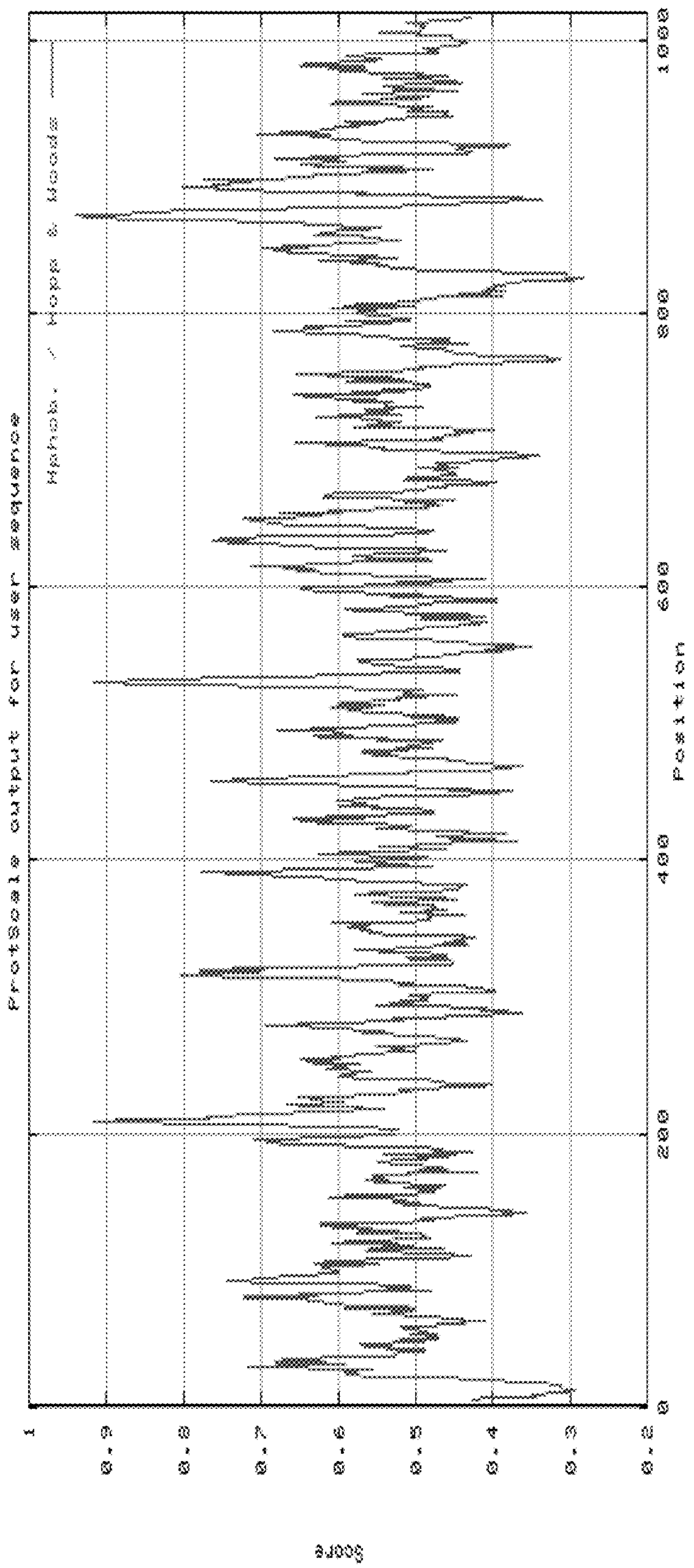
Figure 6B:
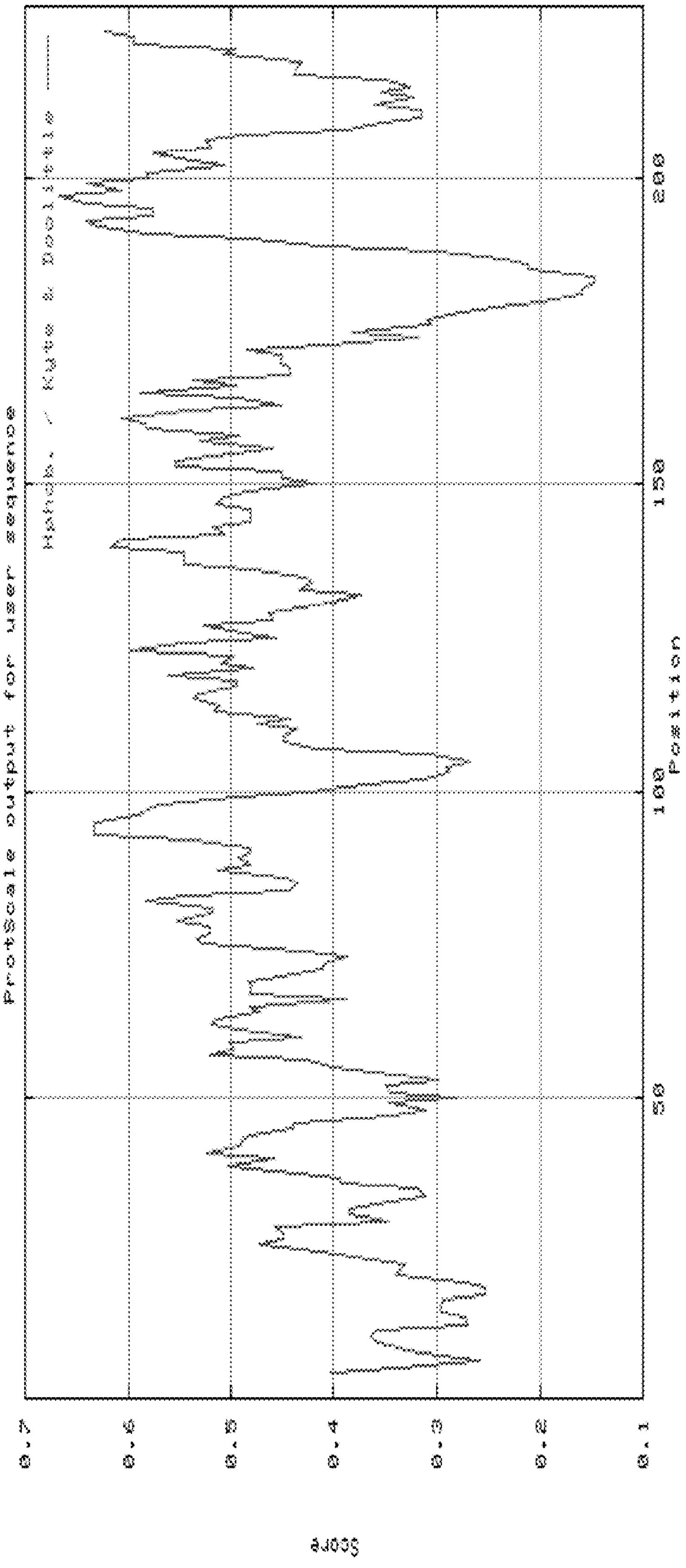
FIGS. 6A-6U. Hydropathicity amino acid profile of the proteins set forth in FIG. 2 determined by computer algorithm sequence analysis using the method of Kyte and Doolittle (Kyte J., Doolittle R. F., 1982. J. Mol. Biol. 157:105-132).
Figure 6C:
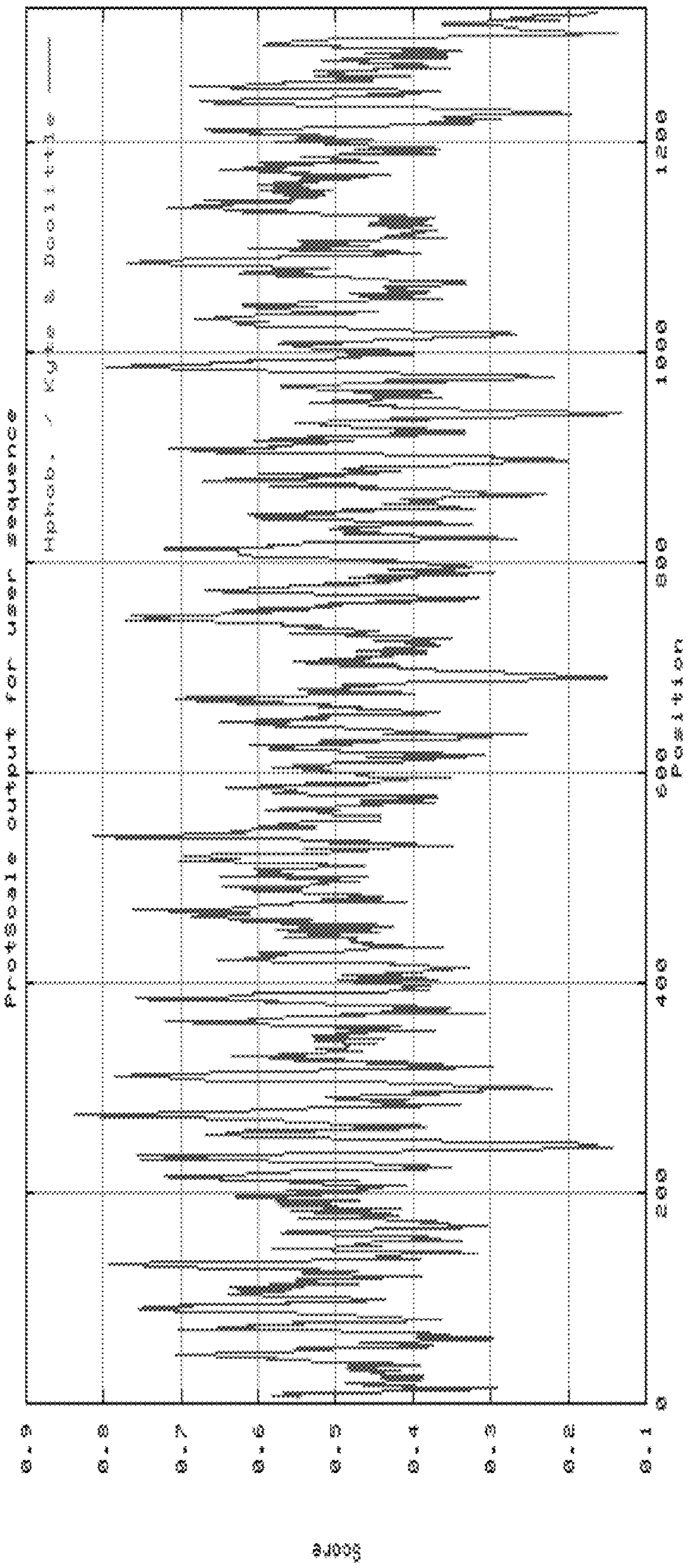
Figure 6D:
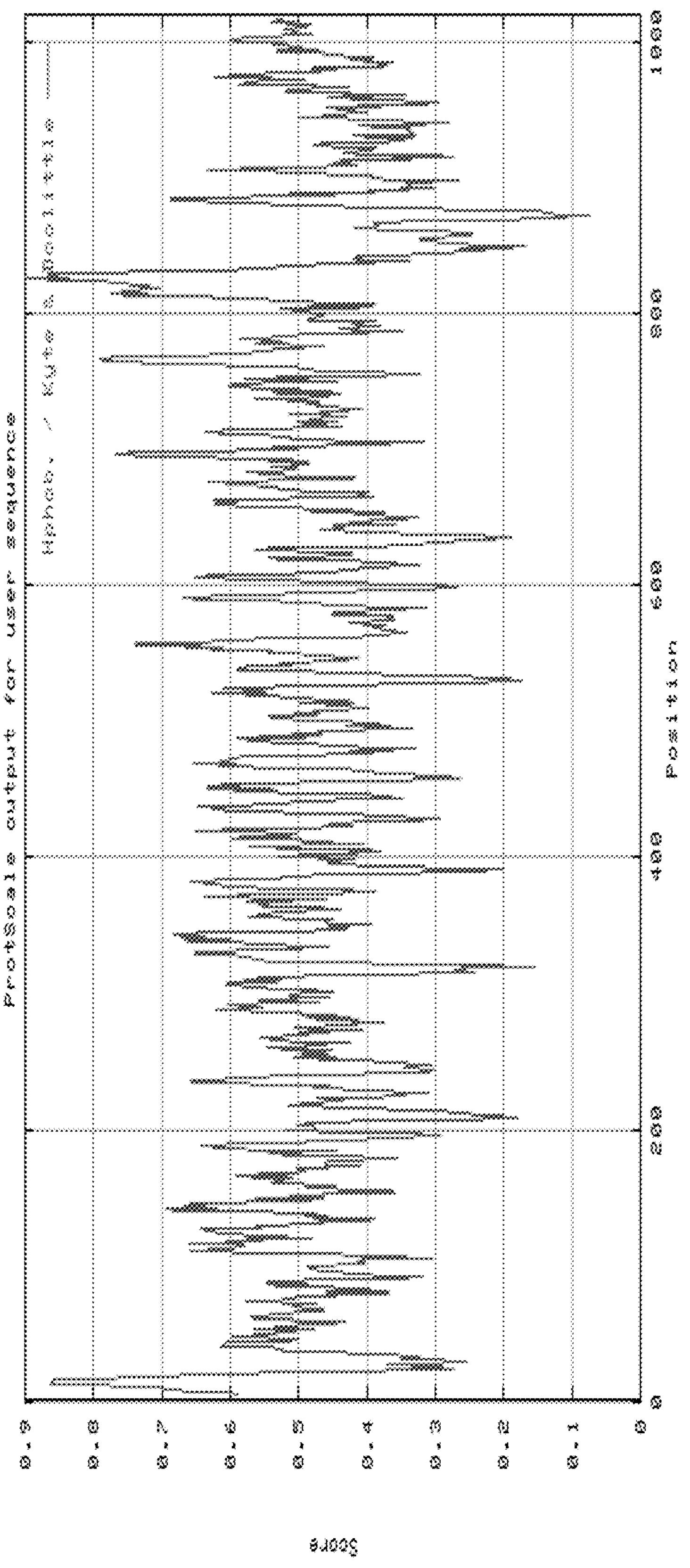
Figure 7A:
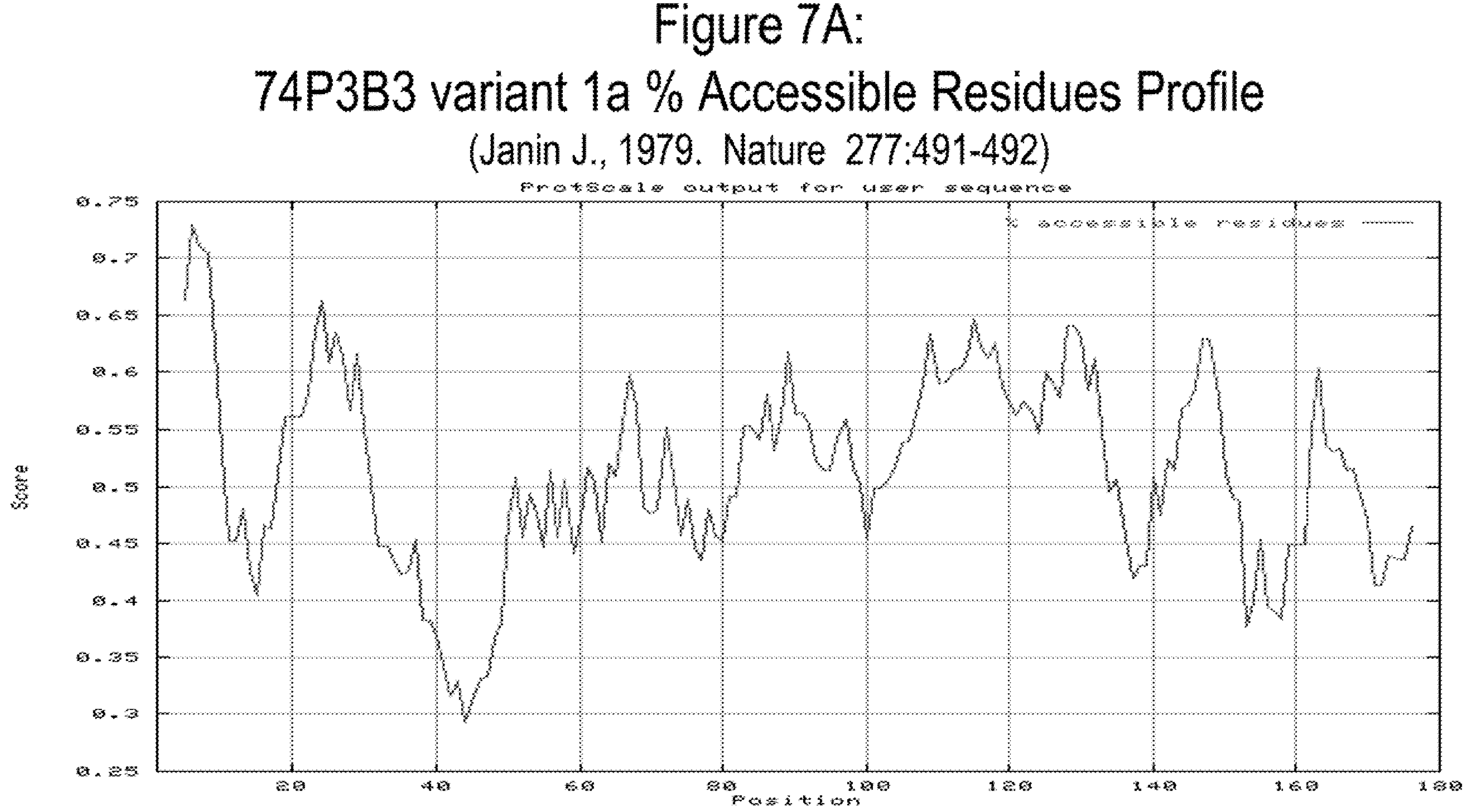
FIGS. 7A-7U. Percent accessible residues amino acid profile of the proteins set forth in FIG. 2 determined by computer algorithm sequence analysis using the method of Janin (Janin J., 1979 Nature 277:491-492).
Figure 7B:
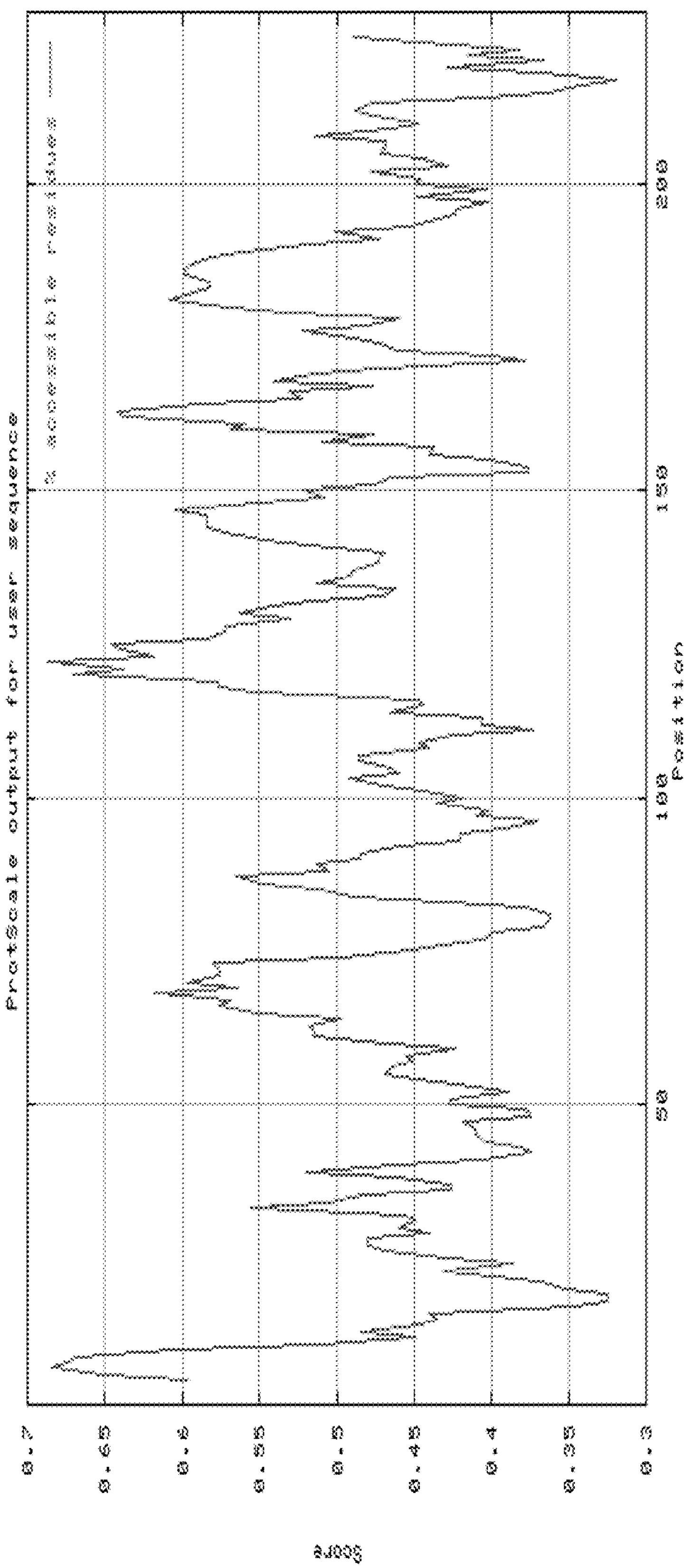
Figure 7C:
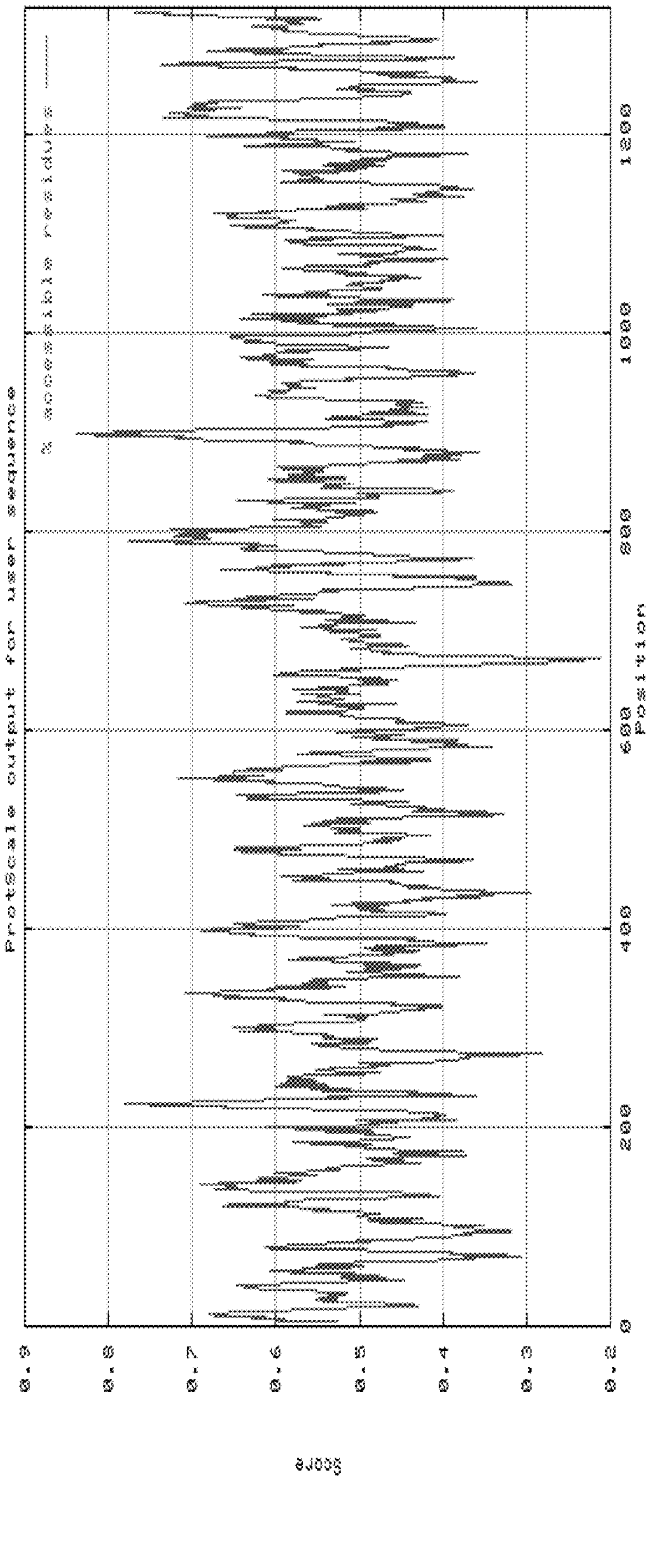
Figure 7D:
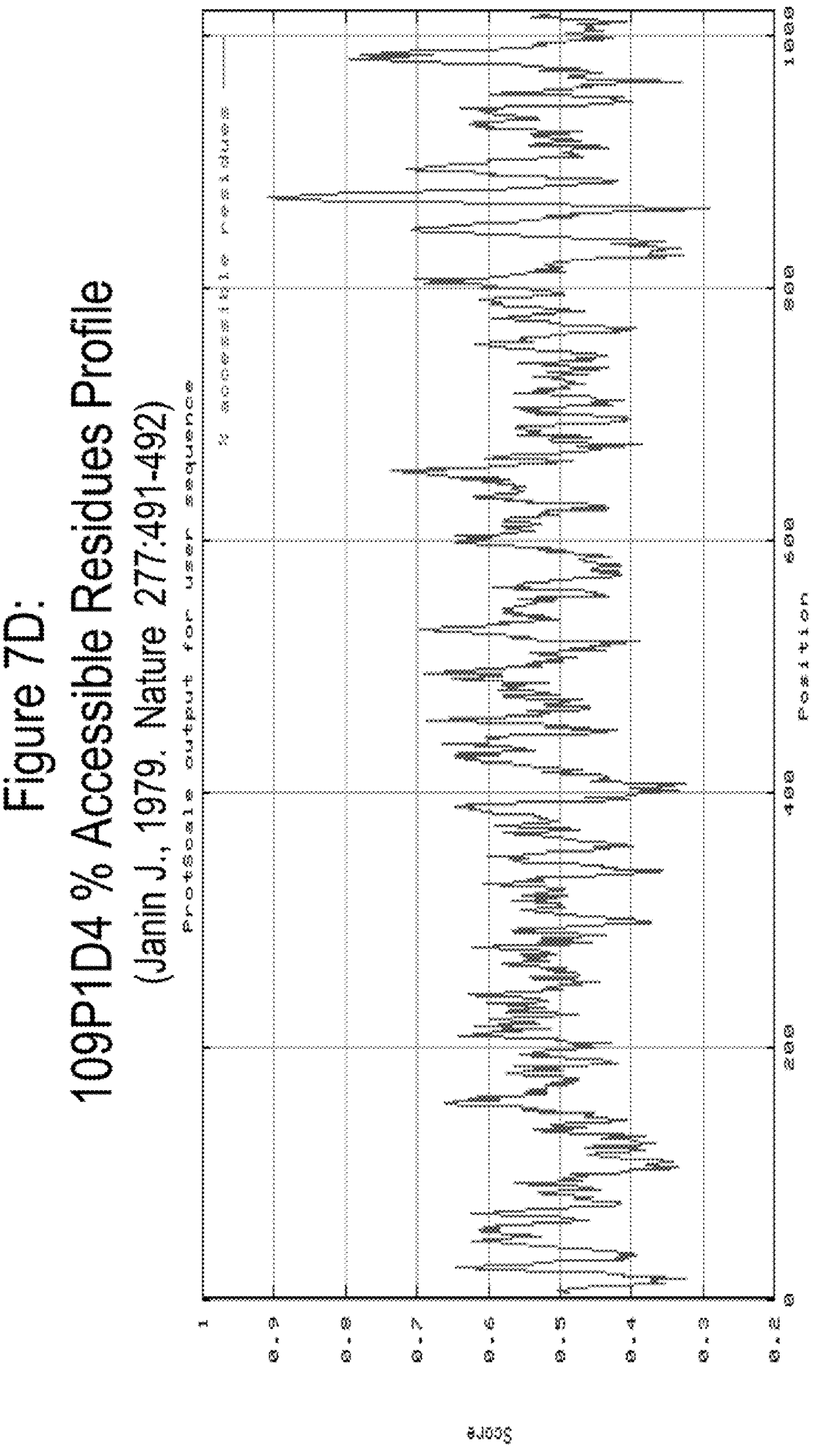
Figure 8A:
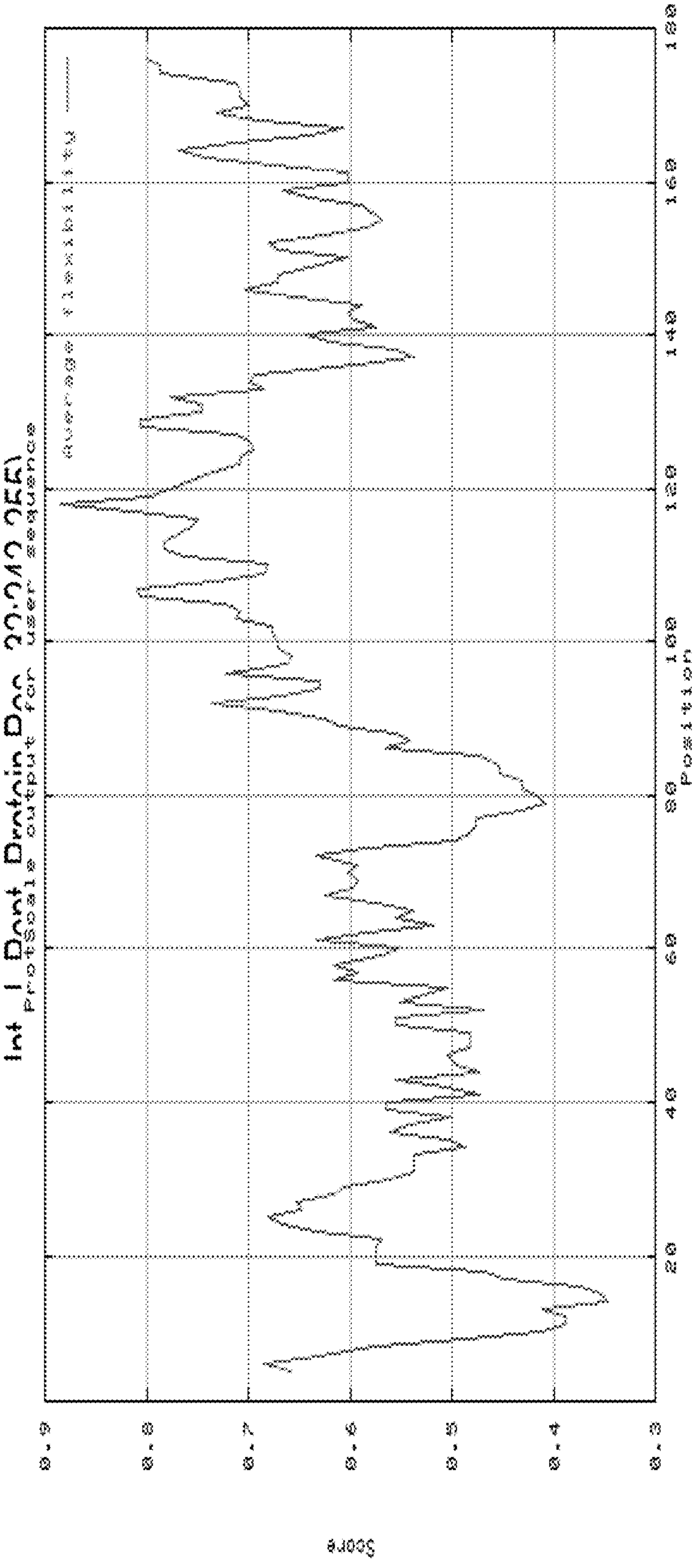
FIGS. 8A-8U. Average flexibility amino acid profile of the proteins set forth in FIG. 2 determined by computer algorithm sequence analysis using the method of Bhaskaran and Ponnuswamy (Bhaskaran R., and Ponnuswamy P. K., 1988. Int. J. Pept. Protein Res. 32:242-255).
Figure 8B:
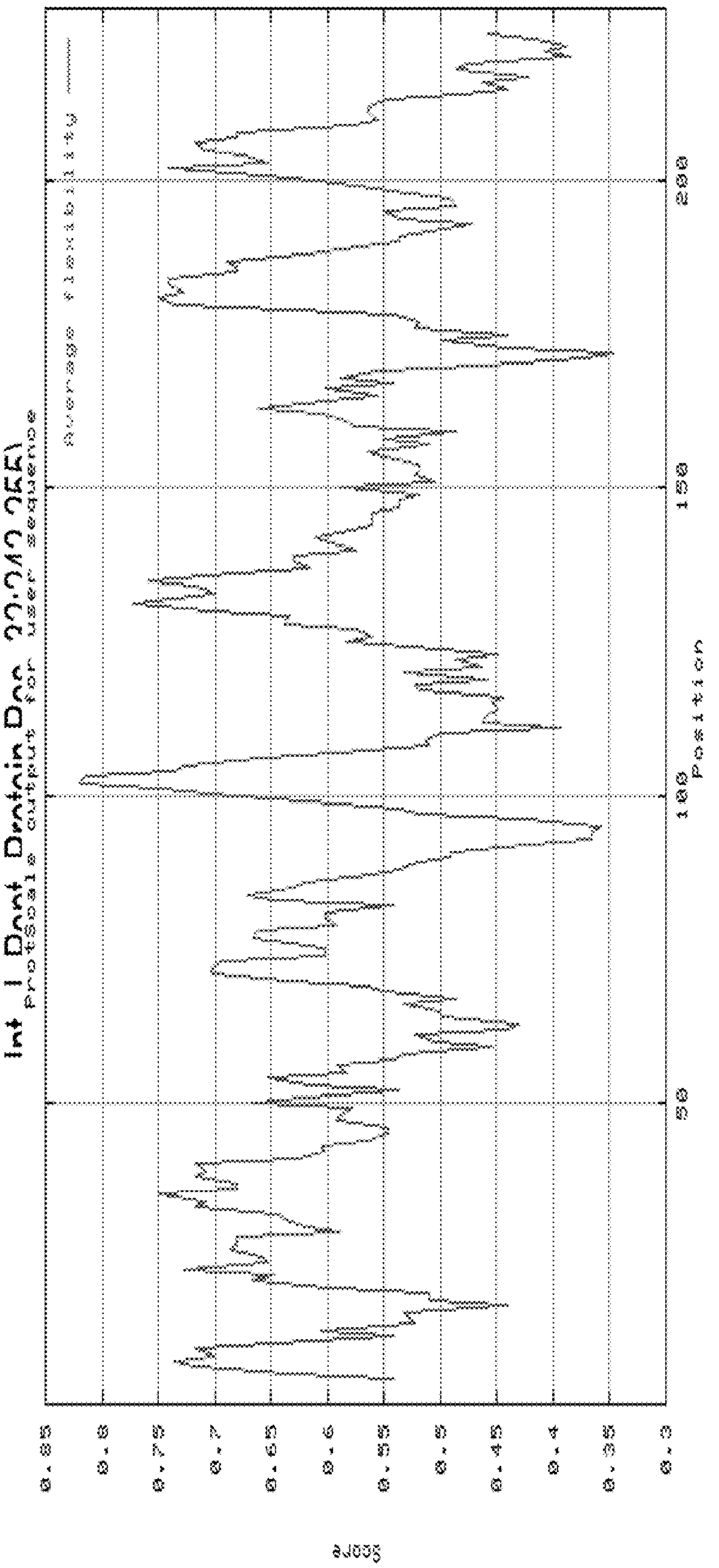
Figure 8C:
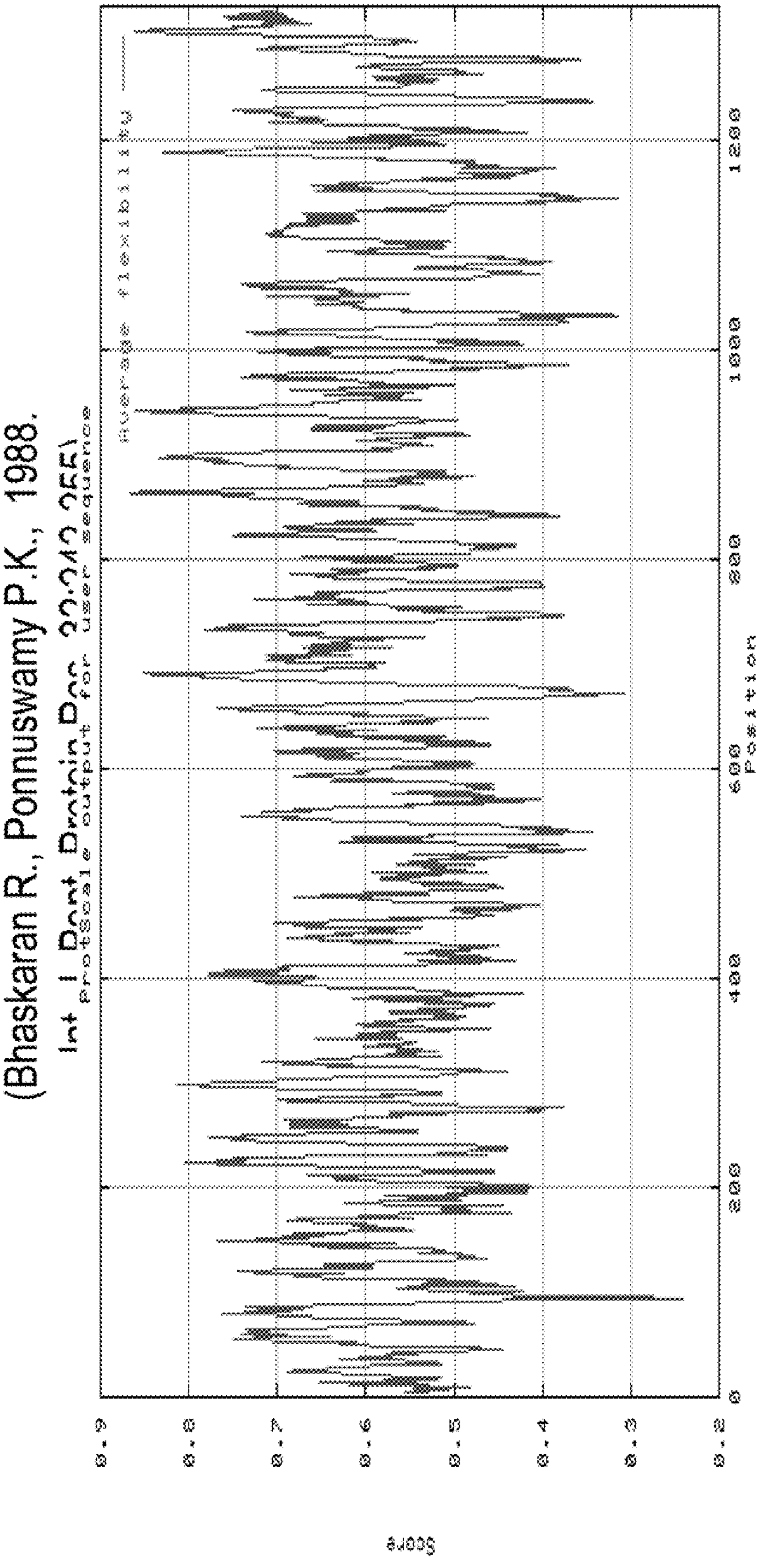
Figure 8D:
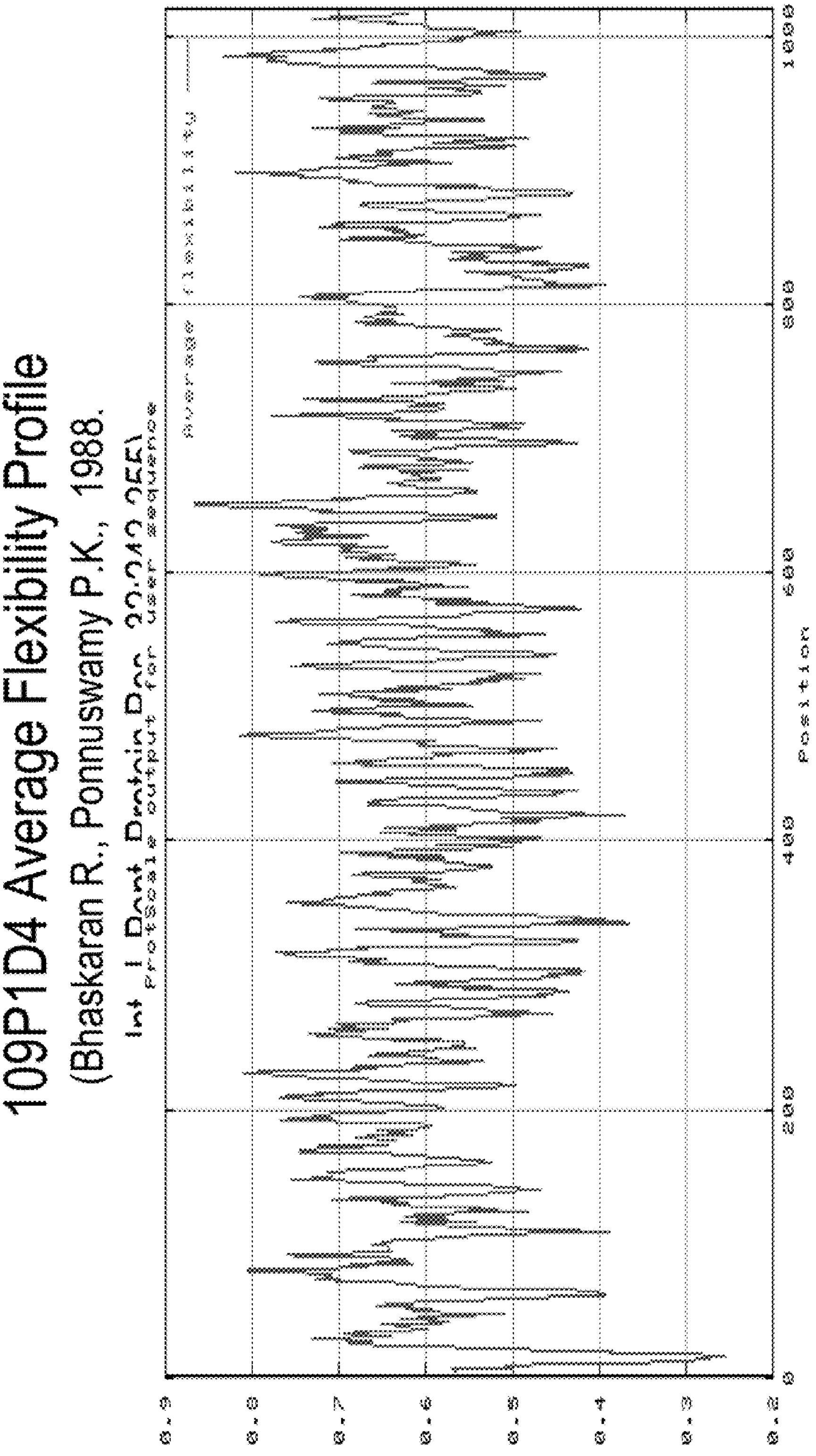
Figure 9A:
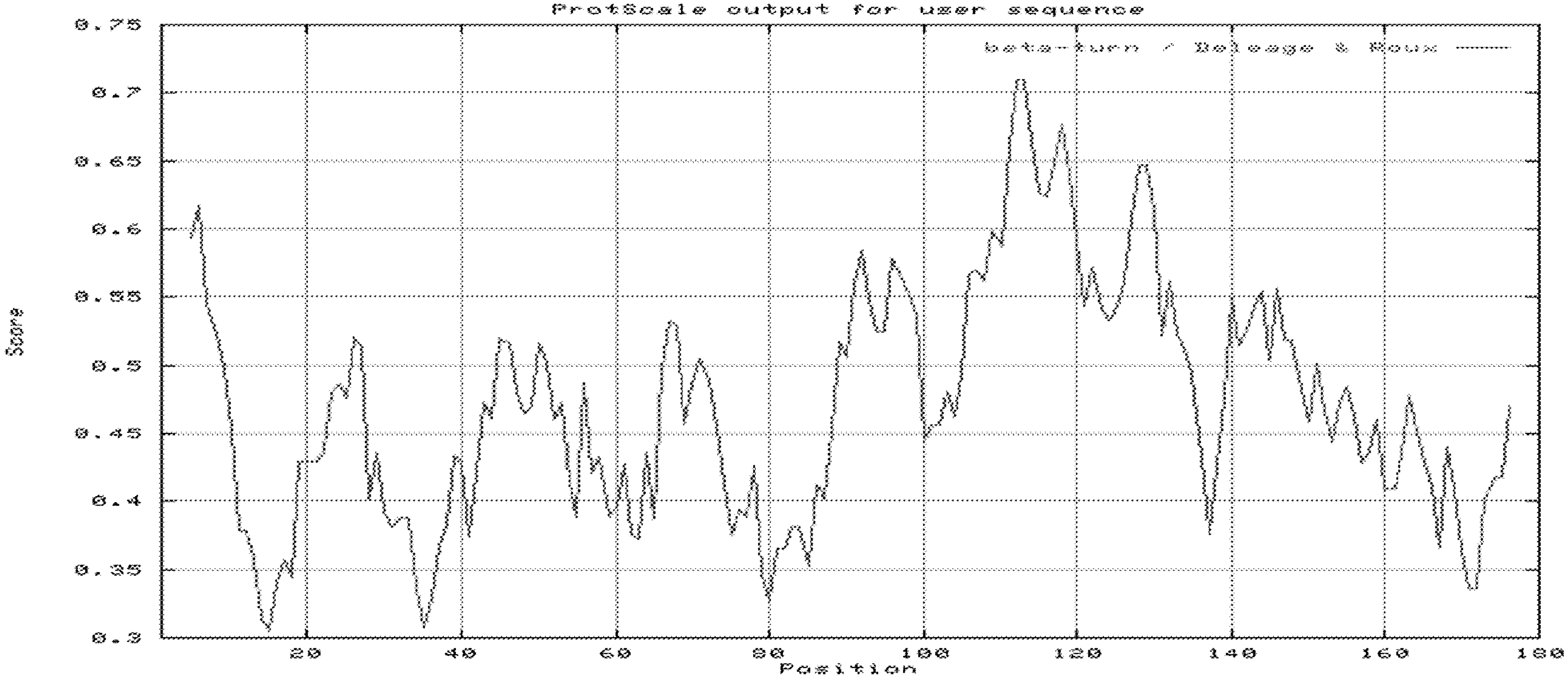
FIGS. 9A-9U. Beta-turn amino acid profile of the proteins set forth in FIG. 2 determined by computer algorithm sequence analysis using the method of Deleage and Roux (Deleage, G., Roux B. 1987 Protein Engineering 1:289-294).
Figure 9B:
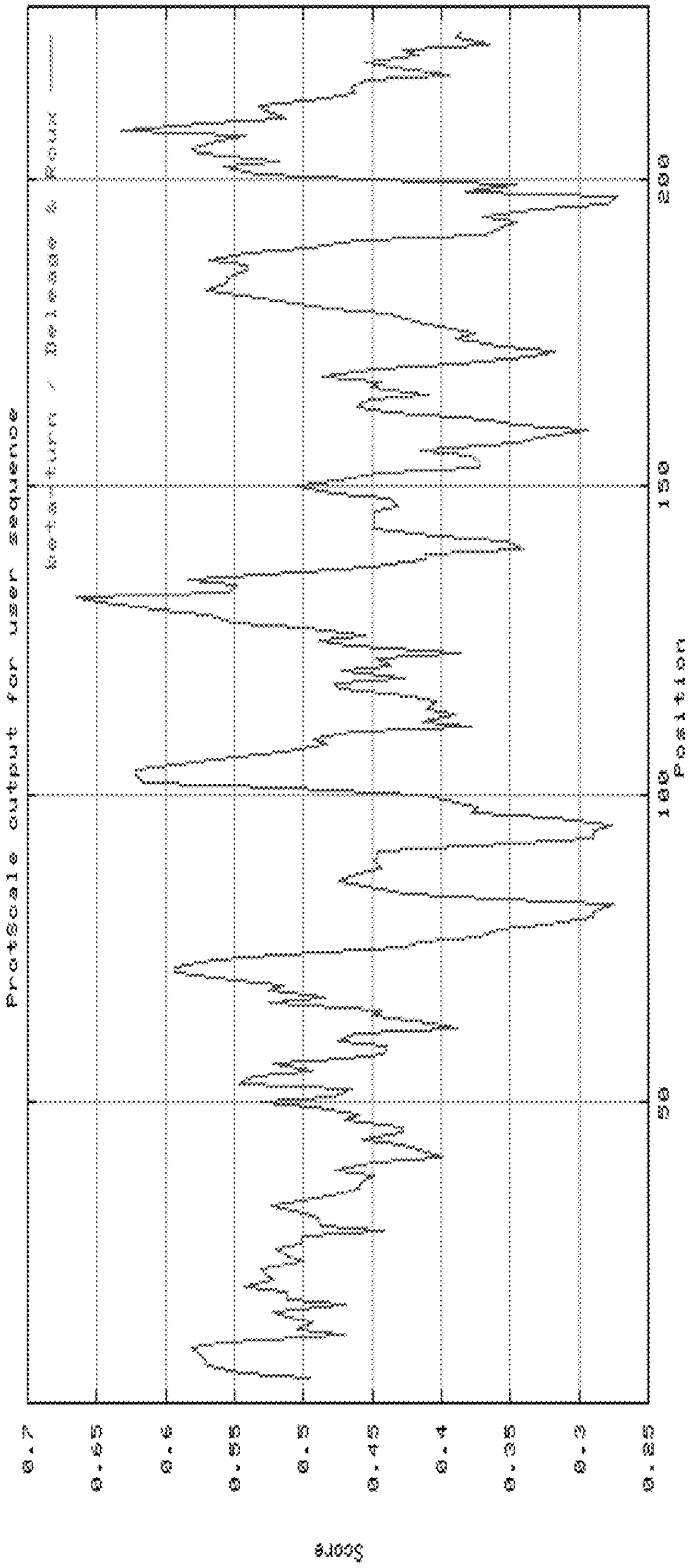
Figure 9C:
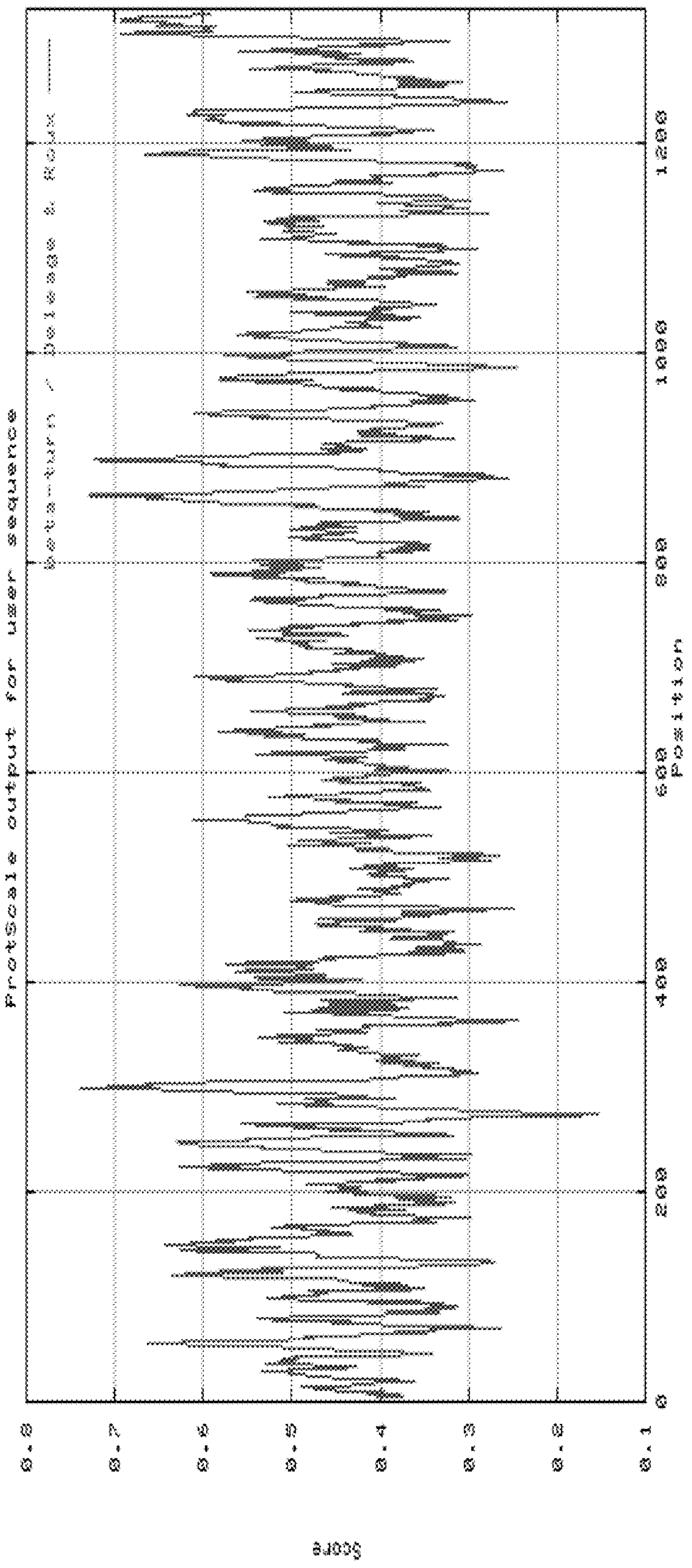
Figure 9D:
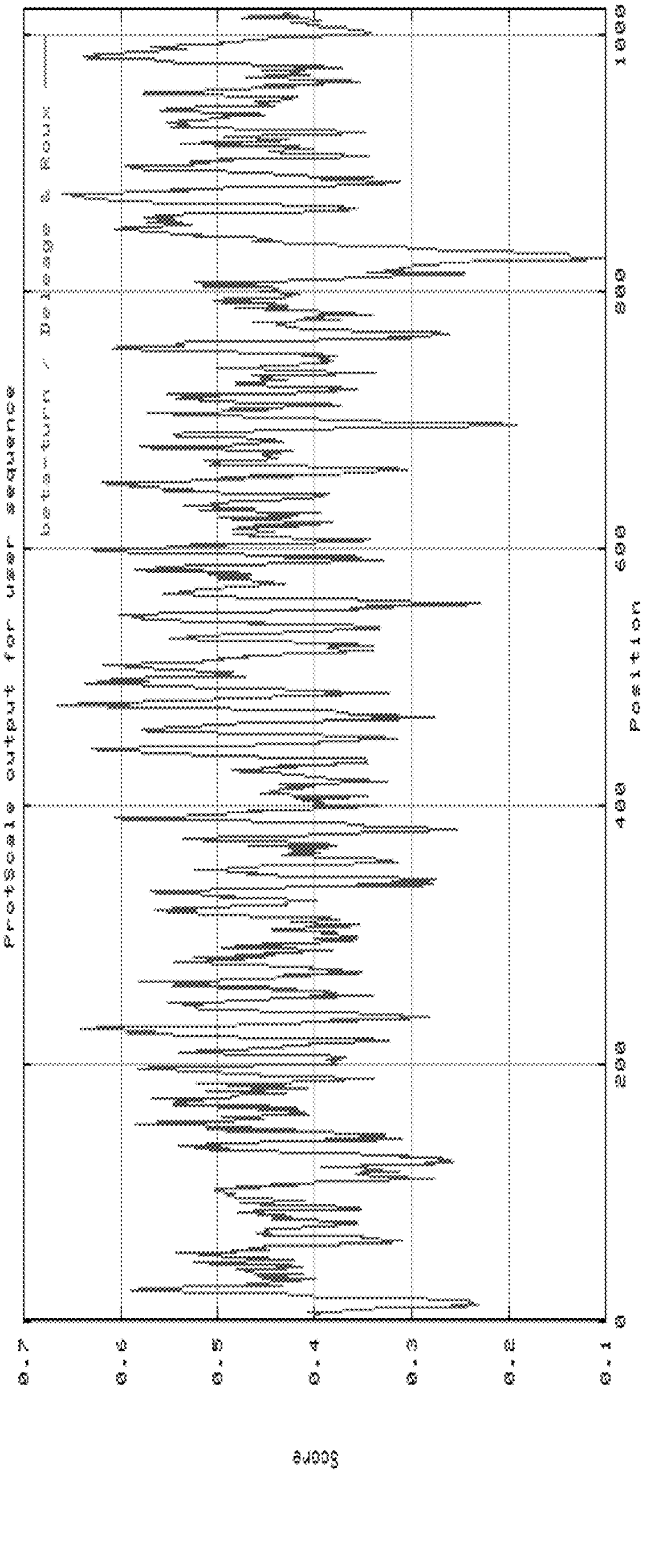

Embodiments of a FIG. 2 polynucleotide include: a FIG. 2 polynucleotide having the sequence shown in FIG. 2, the nucleotide sequence of the genes of FIG. 2 as shown in FIG. 2 wherein T is U; at least 10 contiguous nucleotides of a polynucleotide having the sequence as shown in FIG. 2; or, at least 10 contiguous nucleotides of a polynucleotide having the sequence as shown in FIG. 2 where T is U. For example, embodiments of the FIG. 2 nucleotides comprise, without limitation:

(1) a polynucleotide comprising, consisting essentially of, or consisting of a sequence as shown in FIG. 2, wherein T can also be U;

(2) a polynucleotide comprising, consisting essentially of, or consisting of a sequence as shown in FIG. 2, from the first nucleotide residue of a reading frame through the last nucleotide residue of that reading frame, optionally followed by a stop codon, wherein T can also be U;

(3) a polynucleotide comprising, consisting essentially of, or consisting of the sequence as shown in FIG. 2A.1, from nucleotide residue number 289 through nucleotide residue number 828, optionally followed by a stop codon, wherein T can also be U;

(4) a polynucleotide comprising, consisting essentially of, or consisting of the sequence as shown in FIG. 2A.2, from nucleotide residue number 756 through nucleotide residue number 1439, optionally followed by a stop codon, wherein T can also be U;

(5) a polynucleotide comprising, consisting essentially of, or consisting of the sequence as shown in FIG. 2B, from nucleotide residue number 25 through nucleotide residue number 4008, optionally followed by a stop codon, wherein T can also be U;

(6) a polynucleotide comprising, consisting essentially of, or consisting of the sequence as shown in FIG. 2C, from nucleotide residue number 846 through nucleotide residue number 3908, optionally followed by a stop codon, wherein T can also be U;

(7) a polynucleotide comprising, consisting essentially of, or consisting of the sequence as shown in FIG. 2D, from nucleotide residue number 103 through nucleotide residue number 900, optionally followed by a stop codon, wherein T can also be U;

(8) a polynucleotide comprising, consisting essentially of, or consisting of the sequence as shown in FIG. 2E, from nucleotide residue number 3 through nucleotide residue number 371, optionally followed by a stop codon, wherein T can also be U;

(9) a polynucleotide comprising, consisting essentially of, or consisting of the sequence as shown in FIG. 2F, from nucleotide residue number 250 through nucleotide residue number 1323, optionally followed by a stop codon, wherein T can also be U;

(10) a polynucleotide comprising, consisting essentially of, or consisting of the sequence as shown in FIG. 2G, from nucleotide residue number 24 through nucleotide residue number 599, optionally followed by a stop codon, wherein T can also be U;

(11) a polynucleotide comprising, consisting essentially of, or consisting of the sequence as shown in FIG. 2H, from nucleotide residue number 178 through nucleotide residue number 858, optionally followed by a stop codon, wherein T can also be U;

(12) a polynucleotide comprising, consisting essentially of, or consisting of the sequence as shown in FIG. 21, from nucleotide residue number 1517 through nucleotide residue number 2188, optionally followed by a stop codon, wherein T can also be U;

(13) a polynucleotide comprising, consisting essentially of, or consisting of the sequence as shown in FIG. 2J, from nucleotide residue number 198 through nucleotide residue number 767, optionally followed by a stop codon, wherein T can also be U;

(14) a polynucleotide comprising, consisting essentially of, or consisting of the sequence as shown in FIG. 2K, from nucleotide residue number 72 through nucleotide residue number 1097, optionally followed by a stop codon, wherein T can also be U;

(15) a polynucleotide comprising, consisting essentially of, or consisting of the sequence as shown in FIG. 2L, from nucleotide residue number 118 through nucleotide residue number 1233, optionally followed by a stop codon, wherein T can also be U;

(16) a polynucleotide comprising, consisting essentially of, or consisting of the sequence as shown in FIG. 2M, from nucleotide residue number 14 through nucleotide residue number 2257, optionally followed by a stop codon, wherein T can also be U;

(17) a polynucleotide comprising, consisting essentially of, or consisting of the sequence as shown in FIG. 2N.1, from nucleotide residue number 140 through nucleotide residue number 4060, optionally followed by a stop codon, wherein T can also be U;

(18) a polynucleotide comprising, consisting essentially of, or consisting of the sequence as shown in FIG. 2N.2, from nucleotide residue number 140 through nucleotide residue number 3565, optionally followed by a stop codon, wherein T can also be U;

(19) a polynucleotide comprising, consisting essentially of, or consisting of the sequence as shown in FIG. 2N.3, from nucleotide residue number 140 through nucleotide residue number 4075, optionally followed by a stop codon, wherein T can also be U;

(20) a polynucleotide comprising, consisting essentially of, or consisting of the sequence as shown in FIG. 2(0), from nucleotide residue number 3 through nucleotide residue number 1655, optionally followed by a stop codon, wherein T can also be U;

(21) a polynucleotide comprising, consisting essentially of, or consisting of the sequence as shown in FIG. 2P, from nucleotide residue number 170 through nucleotide residue number 1459, optionally followed by a stop codon, wherein T can also be U;

(22) a polynucleotide comprising, consisting essentially of, or consisting of the sequence as shown in FIG. 2Q, from nucleotide residue number 60 through nucleotide residue number 1559, optionally followed by a stop codon, wherein T can also be U;

(23) a polynucleotide comprising, consisting essentially of, or consisting of the sequence as shown in FIG. 2R, from nucleotide residue number 84 through nucleotide residue number 938, optionally followed by a stop codon, wherein T can also be U;

(24) a polynucleotide that encodes a FIG. 2-*related* protein that is at least 90% homologous to an entire amino acid sequence shown in FIG. 2A-R;

(25) a polynucleotide that encodes a FIG. 2-*related* protein that is at least 90% identical to an entire amino acid sequence shown in FIG. 2A-R;

(26) a polynucleotide that encodes at least one peptide set forth in Tables V-XVIII, Table XX, or Tables XXIII to XXVI;

(27) a polynucleotide that encodes a peptide region of at least five amino acids of a peptide of FIG. 3 in any whole number increment up to the entire length of that protein, that includes an amino acid position having a value greater than 0.5 in the Hydrophilicity profile of FIG. 5 for that protein;

(28) a polynucleotide that encodes a peptide region of at least five amino acids of a peptide of FIG. 3 in any whole number increment up to the entire length of the protein, that includes an amino acid position having a value less than 0.5 in the Hydropathicity profile of FIG. 6 for that protein;

(29) a polynucleotide that encodes a peptide region of at least five amino acids of a peptide of FIG. 3 in any whole number increment up to the entire length of the protein, that includes an amino acid position having a value greater than 0.5 in the Percent Accessible Residues profile of FIG. 7 for that protein;

(30) a polynucleotide that encodes a peptide region of at least 5 amino acids of a peptide of FIG. 3 in any whole number increment up to the entire length of that protein, that includes an amino acid position having a value greater than 0.5 in the Average Flexibility profile of FIG. 8 for that protein;

(31) a polynucleotide that encodes a peptide region of at least 5 amino acids of a peptide of FIG. 3 in any whole number increment up to the entire length of the protein, that includes an amino acid position having a value greater than 0.5 in the Beta-turn profile of FIG. 9 for that protein;

(32) a polynucleotide that encodes a FIG. 2-*related* protein whose sequence is encoded by the cDNAs contained in the plasmid 74P3B3 that was deposited with American Type Culture Collection (ATCC) as Accession No. PTA-1892 on 19 May 2000;

(33) a polynucleotide that is fully complementary to a polynucleotide of any one of (1)-(32);

(34) a polynucleotide that selectively hybridizes under stringent conditions to a polynucleotide of (1) to (33);

(35) a peptide that is encoded by any of (1)-(32); and,

(36) a polynucleotide of any of (1)-(34) or peptide of (35) together with a pharmaceutical excipient and/or in a human unit dose form.

As used herein, a range is understood to specifically disclose all whole unit positions, i.e., integer positions, thereof.

Typical embodiments of the invention disclosed herein include the proteins of FIG. 2 polynucleotides that encode specific portions of the FIG. 2 mRNA sequences (and those which are complementary to such sequences) such as those that encode the proteins and/or fragments thereof, for example:

4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 205, 210, 215, 220, 225, 230, 235, 240, 245, 250, 255, 260, 265, 270, 275, 280, 285, 290, 295, 300, 305, 310, 315, 320, 325, 330, 335, 340, 345, 350, 355, 360, 365, 370, 375, 380, 385, 390, 395, 400, 405, 410, 415, 420, 425, 430, 435, 440, 445, 450, 455, 460, 465, 470, 475, 480, 485, 490, 495, 500, 505, 510, 515, 520, 525, 530, 535, 540, 545, 550, 555, 560, 565, 570, 575, 580, 585, 590, 595, 600, 605, 610, 615, 620, 625, 630, 635, 640, 645, 650, 655, 660, 665, 670, 675, 680, 685, 690, 695, 700, 705, 710, 715, 720, 725, 730, 735, 740, 745, 750, 755, 760, 765, 770, 775, 780, 785, 790, 795, 800, 805, 810, 815, 820, 825, 830, 835, 840, 845, 850, 855, 860, 865, 870, 875, 880, 885, 890, 895, 900, 905, 910, 915, 920, 925, 930, 935, 940, 945, 950, 955, 960, 965, 970, 975, 980, 985, 990, 995, 1000, 1025, 1050, 1075, 1100, 1125, 1150, 1175, 1200, etc., or more contiguous amino acids of a peptide of the invention.

For example, representative embodiments of the invention disclosed herein include: polynucleotides and their encoded peptides themselves encoding about amino acid 1 to about amino acid 10 of a FIG. 2 protein or variants thereof, polynucleotides encoding about amino acid 10 to about amino acid 20 of a FIG. 2 protein or variants thereof, polynucleotides encoding about amino acid 20 to about amino acid 30 of a FIG. 2 protein or variants thereof, polynucleotides encoding about amino acid 30 to about amino acid 40 of a FIG. 2 protein or variants thereof, polynucleotides encoding about amino acid 40 to about amino acid 50 of a FIG. 2 protein or variants thereof, polynucleotides encoding about amino acid 50 to about amino acid 60 of a FIG. 2 protein or variants thereof, polynucleotides encoding about amino acid 60 to about amino acid 70 of a FIG. 2 protein or variants thereof, polynucleotides encoding about amino acid 70 to about amino acid 80 of a FIG. 2 protein or variants thereof, polynucleotides encoding about amino acid 80 to about amino acid 90 of a FIG. 2 protein or variants thereof, polynucleotides encoding about amino acid 90 to about amino acid 100 of a FIG. 2 protein or variants thereof, or encoding regions from about amino acid 100 to amino acids later in the sequence, in increments of about 10 amino acids, ending at the carboxyl terminal amino acid of a protein of the invention, e.g. a protein set forth in FIG. 2 or FIG. 3. Accordingly polynucleotides encoding portions of the amino acid sequence (in increments of about 10 amino acids), of amino acids 100 through the carboxyl terminal amino acid of a FIG. 2 protein are embodiments of the invention. Wherein it is understood that each particular amino acid position discloses that position plus or minus five amino acid residues.

Polynucleotides encoding relatively long portions of a FIG. 2 protein are also within the scope of the invention. For example, polynucleotides encoding from about amino acid 1 (or 20 or 30 or 40 etc.) to about amino acid 20, (or 30, or 40 or 50 etc.) of a FIG. 2 protein or variants thereof can be generated by a variety of techniques well known in the art. These polynucleotide fragments can include any portion of gene of the invention as shown, e.g., in FIG. 2.

Additional illustrative embodiments of the invention disclosed herein include a protein of FIG. 2 polynucleotide fragments encoding one or more of the biological motifs contained within a FIG. 2 protein sequence or a variant sequence thereof, including one or more of the motif-bearing subsequences of a FIG. 2 protein or variant, e.g., set forth in Tables V-XVIII, Table XX, and/or Tables XXIII to XXVI. In another embodiment, typical polynucleotide fragments of the invention encode one or more of the regions of a FIG. 2 protein or variant thereof that exhibit homology to a known molecule. In another embodiment of the invention, typical polynucleotide fragments encode one or more of the FIG. 2 proteins or variants N-glycosylation sites, cAMP and cGMP-dependent protein kinase phosphorylation sites, casein kinase II phosphorylation sites or N-myristoylation site and amidation sites (see, e.g., Table XX).

II.A.) Uses Polynucleotides of the Invention

II.A.1.) Monitoring of Genetic Abnormalities

The polynucleotides of the preceding paragraphs have a number of different specific uses. The human genes set forth in FIG. 2 maps to the chromosomal locations set forth in Example 3. For example, because a FIG. 2 gene map to a particular chromosome, polynucleotides that encode different regions of the FIG. 2 proteins are used to characterize cytogenetic abnormalities of this chromosomal locale, such as abnormalities that are identified as being associated with various cancers. In certain genes, a variety of chromosomal abnormalities including rearrangements have been identified as frequent cytogenetic abnormalities in a number of different cancers (see e.g. Krajinovic et al., Mutat. Res. 382(3-4): 81-83 (1998); Johansson et al., Blood 86(10): 3905-3914 (1995) and Finger et al., P.N.A.S. 85(23): 9158-9162 (1988)). Thus, polynucleotides encoding specific regions of the FIG. 2 proteins provide new tools that can be used to delineate, with greater precision than previously possible, cytogenetic abnormalities in the chromosomal region that encodes the proteins set forth in FIG. 2 that may contribute to the malignant phenotype. In this context, these polynucleotides satisfy a need in the art for expanding the sensitivity of chromosomal screening in order to identify more subtle and less common chromosomal abnormalities (see e.g. Evans et al., Am. J. Obstet. Gynecol 171(4): 1055-1057 (1994)).

Furthermore, as the genes set forth in FIG. 2 are shown to be highly expressed in cancers, the FIG. 2 polynucleotides are used in methods assessing the status of the FIG. 2 gene products in normal versus cancerous tissues. Typically, polynucleotides that encode specific regions of the FIG. 2 proteins are used to assess the presence of perturbations (such as deletions, insertions, point mutations, or alterations resulting in a loss of an antigen etc.) in specific regions of the FIG. 2 genes, such as regions containing one or more motifs. Exemplary assays include both RT-PCR assays as well as single-strand conformation polymorphism (SSCP) analysis (see, e.g., Marrogi et al., J. Cutan. Pathol. 26(8): 369-378 (1999), both of which utilize polynucleotides encoding specific regions of a protein to examine these regions within the protein.

II.A.2.) Antisense Embodiments

Other specifically contemplated nucleic acid related embodiments of the invention disclosed herein are genomic DNA, cDNAs, ribozymes, and antisense molecules, as well as nucleic acid molecules based on an alternative backbone, or including alternative bases, whether derived from natural sources or synthesized, and include molecules capable of inhibiting the RNA or protein expression of a gene set forth in FIG. 2. For example, antisense molecules can be RNAs or other molecules, including peptide nucleic acids (PNAs) or non-nucleic acid molecules such as phosphorothioate derivatives, that specifically bind DNA or RNA in a base pair-dependent manner. A skilled artisan can readily obtain these classes of nucleic acid molecules using the FIG. 2 polynucleotides and polynucleotide sequences disclosed herein.

Antisense technology entails the administration of exogenous oligonucleotides that bind to a target polynucleotide located within the cells. The term "antisense" refers to the fact that such oligonucleotides are complementary to their intracellular targets, e.g., a gene of FIG. 2. See for example, Jack Cohen, Oligodeoxynucleotides, Antisense Inhibitors of Gene Expression, CRC Press, 1989; and Synthesis 1:1-5 (1988). The FIG. 2 antisense oligonucleotides of the present invention include derivatives such as S-oligonucleotides (phosphorothioate derivatives or S-oligos, see, Jack Cohen, supra), which exhibit enhanced cancer cell growth inhibitory action. S-oligos (nucleoside phosphorothioates) are isoelectronic analogs of an oligonucleotide (O-oligo) in which a nonbridging oxygen atom of the phosphate group is replaced by a sulfur atom. The S-oligos of the present invention can be prepared by treatment of the corresponding O-oligos with 3H-1,2-benzodithiol-3-one-1,1-dioxide, which is a sulfur transfer reagent. See, e.g., Iyer, R. P. et al., J. Org. Chem. 55:4693-4698 (1990); and Iyer, R. P. et al., J. Am. Chem. Soc. 112:1253-1254 (1990). Additionally, the FIG. 2 antisense oligonucleotides of the present invention include morpholino antisense oligonucleotides known in the art (see, e.g., Partridge et al., 1996, Antisense & Nucleic Acid Drug Development 6: 169-175).

The FIG. 2 antisense oligonucleotides of the present invention typically can be RNA or DNA that is complementary to and stably hybridizes with the first 100 5' codons or last 100 3' codons of a genomic sequence or the corresponding mRNA of the invention. Absolute complementarity is not required, although high degrees of complementarity are preferred. Use of an oligonucleotide complementary to this region allows for the selective hybridization to mRNA of the invention and not to mRNA specifying other regulatory subunits of protein kinase. In one embodiment, the FIG. 2 antisense oligonucleotides of the present invention are 15 to 30-mer fragments of the antisense DNA molecule that have a sequence that hybridizes to mRNA of the invention. Optionally, a FIG. 2 antisense oligonucleotide is a 30-mer oligonucleotide that is complementary to a region in the first 10 5' codons or last 10 3' codons of a gene set forth in FIG. 2. Alternatively, the antisense molecules are modified to employ ribozymes in the inhibition of expression of a gene set forth in FIG. 2, see, e.g., L. A. Couture & D. T. Stinchcomb; *Trends Genet* 12: 510-515 (1996).

II.A.3.) Primers and Primer Pairs

Further specific embodiments of the nucleotides of the invention include primers and primer pairs, which allow the specific amplification of polynucleotides of the invention or of any specific parts thereof, and probes that selectively or specifically hybridize to nucleic acid molecules of the invention or to any part thereof. Probes can be labeled with a detectable marker, such as, for example, a radioisotope, fluorescent compound, bioluminescent compound, a chemiluminescent compound, metal chelator or enzyme. Such probes and primers are used to detect the presence of a FIG. 2 polynucleotide in a sample and as a means for detecting a cell expressing a FIG. 2 protein.

Examples of such probes include polynucleotides comprising all or part of a human gene set forth in FIG. 2. Examples of primer pairs capable of specifically amplifying an mRNA of the invention are also disclosed herein. As will be understood by the skilled artisan, a great many different primers and probes can be prepared based on the sequences provided herein and used effectively to amplify and/or detect an mRNA of the invention.

The FIG. 2 polynucleotides of the invention are useful for a variety of purposes, including but not limited to their use as probes and primers for the amplification and/or detection of the FIG. 2 gene(s), mRNA(s), or fragments thereof; as reagents for the diagnosis and/or prognosis of prostate cancer and other cancers; as coding sequences capable of directing the expression of a FIG. 2 polypeptide; as tools for modulating or inhibiting the expression of a FIG. 2 gene(s) and/or translation of a FIG. 2 transcript(s); and as therapeutic agents.

The present invention includes the use of any probe as described herein to identify and isolate a gene set forth in FIG. 2 or FIG. 2-*related* nucleic acid sequence of the invention from a naturally occurring source, such as humans or other mammals, as well as the isolated nucleic acid sequence per se, which would comprise all or most of the sequences found in the probe used.

II.A.4.) Isolation of Nucleic Acid Molecules that Encode Proteins of the Invention The cDNA sequences described herein, see, e.g., FIG. 2, enable the isolation of other polynucleotides encoding gene product(s) of the invention, as well as the isolation of polynucleotides encoding homologs of protein of FIG. 2, alternatively spliced isoforms, allelic variants, and mutant forms of agene product of a gene of the invention as well as polynucleotides that encode analogs of the FIG. 2-*related* proteins. Various molecular cloning methods that can be employed to isolate full length cDNAs encoding a FIG. 2 gene are well known (see, for example, Sambrook, J. et al., Molecular Cloning: A Laboratory Manual, 2d edition, Cold Spring Harbor Press, New York, 1989; Current Protocols in Molecular Biology. Ausubel et al., Eds., Wiley and Sons, 1995). For example, lambda phage cloning methodologies can be conveniently employed, using commercially available cloning systems (e.g., Lambda ZAP Express, Stratagene). Phage clones containing a FIG. 2 gene cDNA can be identified by probing with a labeled cDNA of FIG. 2 or a fragment thereof. For example, in one embodiment, a FIG. 2 cDNA or a portion thereof is synthesized and used as a probe to retrieve overlapping and full-length cDNAs corresponding to a gene set forth in FIG. 2. A gene set forth in FIG. 2 itself can be isolated by screening genomic DNA libraries, bacterial artificial chromosome libraries (BACs), yeast artificial chromosome libraries (YACs), and the like, with a respective gene in FIG. 2 DNA probe or primer.

II.A.5.) Recombinant Nucleic Acid Molecules and Host-Vector Systems

The invention also provides recombinant DNA or RNA molecules containing a polynucleotide, a fragment, analog or homologue thereof in accordance with the invention, including but not limited to phages, plasmids, phagemids, cosmids, YACs, BACs, as well as various viral and non-viral vectors well known in the art, and cells transformed or transfected with such recombinant DNA or RNA molecules. Methods for generating such molecules are well known (see, for example, Sambrook et al., 1989, supra).

The invention further provides a host-vector system comprising a recombinant DNA molecule containing polynucleotide (fragment, analog or homologue thereof) in accordance with the invention within a suitable prokaryotic or eukaryotic host cell. Examples of suitable eukaryotic host cells include a yeast cell, a plant cell, or an animal cell, such as a mammalian cell or an insect cell (e.g., a baculovirus-infectible cell such as an Sf9 or HighFive cell). Examples of suitable mammalian cells include various prostate cancer cell lines such as DU145 and TsuPr1, other transfectable or transducible prostate cancer cell lines, primary cells (PrEC), as well as a number of mammalian cells routinely used for the expression of recombinant proteins (e.g., COS, CHO, 293, 293T cells). More particularly, a polynucleotide comprising the coding sequence of a protein in FIG. 2 or a fragment, analog or homolog thereof can be used to generate FIG. 2 proteins or fragments thereof using any number of host-vector systems routinely used and widely known in the art.

A wide range of host-vector systems suitable for the expression of FIG. 2 proteins or fragments thereof are available, see for example, Sambrook et al., 1989, supra; Current Protocols in Molecular Biology, 1995, supra). Preferred vectors for mammalian expression include but are not limited to pcDNA 3.1 myc-His-tag (Invitrogen) and the retroviral vector pSRαtkneo (Muller et al., 1991, MCB 11: 1785). Using these expression vectors, proteins set forth in FIG. 2 can be expressed in several prostate cancer and non-prostate cell lines, including for example 293, 293T, rat-1, NIH 3T3 and TsuPr1. The host-vector systems of the invention are useful for the production of a FIG. 2 protein or fragment thereof. Such host-vector systems can be employed to study the functional properties of proteins set forth in FIG. 2 and of the proteins of FIG. 2 mutations or analogs.

Recombinant human proteins of the invention, e.g., set forth in FIG. 2, or an analog or homolog or fragment thereof can be produced by mammalian cells transfected with a construct containing a FIG. 2-*related* nucleotide. For example, 293T cells can be transfected with an expression plasmid encoding a protein of FIG. 2 or fragment, analog or homolog thereof, a FIG. 2-*related* protein is expressed in the 293T cells, and the recombinant protein of the invention is isolated using standard purification methods (e.g., affinity purification using antibodies of the invention, e.g., an antibody that specifically binds a protein of the invention such as one set forth in FIG. 2). In another embodiment, a FIG. 2 coding sequence is subcloned into the retroviral vector pSRαMSVtkneo and used to infect various mammalian cell lines, such as NIH 3T3, TsuPr1, 293 and rat-1 in order to establish cell lines that express a protein of the invention. Various other expression systems well known in the art can also be employed. Expression constructs encoding a leader peptide joined in frame to a FIG. 2 coding sequence can be used for the generation of a secreted form of recombinant FIG. 2 proteins.

As discussed herein, redundancy in the genetic code permits variation in the gene sequences set forth in FIG. 2. In particular, it is known in the art that specific host species often have specific codon preferences, and thus one can adapt the disclosed sequence as preferred for a desired host. For example, preferred analog codon sequences typically have rare codons (i.e., codons having a usage frequency of less than about 20% in known sequences of the desired host) replaced with higher frequency codons. Codon preferences for a specific species are calculated, for example, by utilizing codon usage tables.

Additional sequence modifications are known to enhance protein expression in a cellular host. These include elimination of sequences encoding spurious polyadenylation signals, exon/intron splice site signals, transposon-like repeats, and/or other such well-characterized sequences that are deleterious to gene expression. The GC content of the sequence is adjusted to levels average for a given cellular host, as calculated by reference to known genes expressed in the host cell. Where possible, the sequence is modified to avoid predicted hairpin secondary mRNA structures. Other useful modifications include the addition of a translational initiation consensus sequence at the start of the open reading frame, as described in Kozak, *Mol. Cell Biol.,* 9:5073-5080 (1989). Skilled artisans understand that the general rule that eukaryotic ribosomes initiate translation exclusively at the 5' proximal AUG codon is abrogated only under rare conditions (see, e.g., Kozak PNAS 92(7): 2662-2666, (1995) and Kozak NAR 15(20): 8125-8148 (1987)).

III.) Proteins of the Invention

Another aspect of the present invention provides FIG. 2-*related* proteins, i.e., proteins of the invention. Specific embodiments of FIG. 2-*related* proteins comprise a polypeptide having all or part of the amino acid sequence of a human protein set forth in FIG. 2. Alternatively, embodiments of FIG. 2 proteins comprise variant, homolog or analog polypeptides that have alterations in their amino acid sequence relative to a protein set forth in FIG. 2.

In general, naturally occurring allelic variants of a protein set forth in FIG. 2 shares a high degree of structural identity and homology (e.g., 90% or more homology). Typically, allelic variants of a FIG. 2 protein contain conservative amino acid substitutions within the protein sequences set forth in FIG. 2 described herein or contain a substitution of an amino acid from a corresponding position in a homologue of a protein set forth in FIG. 2. One class of FIG. 2 allelic variants are proteins that share a high degree of homology with at least a small region of a particular FIG. 2 amino acid sequence, but further contain a radical departure from the sequence, such as a non-conservative substitution, truncation, insertion or frame shift. In comparisons of protein sequences, the terms, similarity, identity, and homology each have a distinct meaning as appreciated in the field of genetics. Moreover, orthology and paralogy can be important concepts describing the relationship of members of a given protein family in one organism to the members of the same family in other organisms.

Amino acid abbreviations are provided in Table II. Conservative amino acid substitutions can frequently be made in a protein without altering either the conformation or the function of the protein. Proteins of the invention can comprise 1, 2, 3, 4, 5, 6, 7, 8, 9, 10, 11, 12, 13, 14, 15 conservative substitutions. Such changes include substituting any of isoleucine (I), valine (V), and leucine (L) for any other of these hydrophobic amino acids; aspartic acid (D) for glutamic acid (E) and vice versa; glutamine (Q) for asparagine (N) and vice versa; and serine (S) for threonine (T) and vice versa. Other substitutions can also be considered conservative, depending on the environment of the particular amino acid and its role in the three-dimensional structure of the protein. For example, glycine (G) and alanine (A) can frequently be interchangeable, as can alanine (A) and valine (V). Methionine (M), which is relatively hydrophobic, can frequently be interchanged with leucine and isoleucine, and sometimes with valine. Lysine (K) and arginine (R) are frequently interchangeable in locations in which the significant feature of the amino acid residue is its charge and the differing pK's of these two amino acid residues are not significant. Still other changes can be considered "conservative" in particular environments (see, e.g. Table III herein; pages 13-15 "Biochemistry" $2^{nd}$ ED. Lubert Stryer ed (Stanford University); Henikoff et al., PNAS 1992 Vol 89 10915-10919; Lei et al., J Biol Chem 1995 May 19; 270(20):11882-6).

Embodiments of the invention disclosed herein include a wide variety of art-accepted variants or analogs of FIG. 2 proteins such as polypeptides having amino acid insertions, deletions and substitutions. FIG. 2 variants can be made using methods known in the art such as site-directed mutagenesis, alanine scanning, and PCR mutagenesis. Site-directed mutagenesis (Carter et al., *Nucl. Acids Res.,* 13:4331 (1986); Zoller et al., *Nucl. Acids Res.,* 10:6487 (1987)), cassette mutagenesis (Wells et al., *Gene,* 34:315 (1985)), restriction selection mutagenesis (Wells et al., *Philos. Trans. R. Soc. London SerA,* 317:415 (1986)) or other known techniques can be performed on the cloned DNA to produce variant DNA in accordance with the invention.

Scanning amino acid analysis can also be employed to identify one or more amino acids along a contiguous sequence that is involved in a specific biological activity such as a protein-protein interaction. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant. Alanine is also typically preferred because it is the most common amino acid. Further, it is frequently found in both buried and exposed positions (Creighton, *The Proteins*, (W.H. Freeman & Co., N.Y.); Chothia, J. Mol. Biol., 150:1 (1976)). If alanine substitution does not yield adequate amounts of variant, an isosteric amino acid can be used.

As defined herein, FIG. 2 variants, analogs or homologs, have the distinguishing attribute of having at least one epitope that is "cross reactive" with a protein of FIG. 2. As used in this sentence, "cross reactive" means that an antibody or T cell that specifically binds to a FIG. 2 variant also specifically binds to a FIG. 2 protein having an amino acid sequence set forth in FIG. 3. A polypeptide ceases to be a variant of a protein shown in FIG. 3, when it no longer contains any epitope capable of being recognized by an antibody or T cell that specifically binds to the starting of a FIG. 2 protein. Those skilled in the art understand that antibodies that recognize proteins bind to epitopes of varying size, and a grouping of the order of about four or five amino acids, contiguous or not, is regarded as a typical number of amino acids in a minimal epitope. See, e.g., Nair et al., J. Immunol 2000 165 (12): 6949-6955; Hebbes et al., Mol Immunol (1989) 26(9): 865-73; Schwartz et al., J Immunol (1985) 135(4):2598-608.

Other classes of FIG. 2-*related* protein variants share 50%, 55%, 60%, 65%, 70%, 75%, 80%, 85%, 86%, 87%, 88%, 89%, 90%, 91%, 92%, 93%, 94%, 95%, 96%, 97%, 98%, 99%, or more similarity, homology or identity with an amino acid sequence of FIG. 3, or a fragment thereof. Another specific class of FIG. 2 protein variants or analogs comprise one or more of the FIG. 2 biological motifs described herein (see, e.g., Table V or XVIII, Table XX, or Tables XXIII to XXVI) or presently known in the art. Thus, encompassed by the present invention are analogs of the proteins set forth in FIG. 2 fragments (nucleic or amino acid) that have altered functional (e.g. immunogenic) properties relative to the starting fragment. It is to be appreciated that motifs now or which become part of the art are to be applied to the nucleic or amino acid sequences of FIG. 2 or FIG. 3.

As discussed herein, embodiments of the claimed invention include polypeptides containing less than the full amino acid sequence of a protein shown in FIG. 2 or FIG. 3. For example, representative embodiments of the invention comprise peptides/proteins having any: 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 205, 210, 215, 220, 225, 230, 235, 240, 245, 250, 255, 260, 265, 270, 275, 280, 285, 290, 295, 300, 305, 310, 315, 320, 325, 330, 335, 340, 345, 350, 355, 360, 365, 370, 375, 380, 385, 390, 395, 400, 405, 410, 415, 420, 425, 430, 435, 440, 445, 450, 455, 460, 465, 470, 475, 480, 485, 490, 495, 500, 505, 510, 515, 520, 525, 530, 535, 540, 545, 550, 555, 560, 565, 570, 575, 580, 585, 590, 595, 600, 605, 610, 615, 620, 625, 630, 635, 640, 645, 650, 655, 660, 665, 670, 675, 680, 685, 690, 695, 700, 705, 710, 715, 720, 725, 730, 735, 740, 745, 750, 755, 760, 765, 770, 775, 780, 785, 790, 795, 800, 805, 810, 815, 820, 825, 830, 835, 840, 845, 850, 855, 860, 865, 870, 875, 880, 885, 890, 895, 900, 905, 910, 915, 920, 925, 930, 935, 940, 945, 950, 955, 960, 965, 970, 975, 980, 985, 990, 995, 1000, 1025, 1050, 1075, 1100, 1125, 1150, 1175, 1200, etc., or more contiguous amino acids of a protein shown in FIG. 2 or FIG. 3.

Moreover, representative embodiments of the invention disclosed herein include polypeptides consisting of about amino acid 1 to about amino acid 10 of a FIG. 2 protein shown, polypeptides consisting of about amino acid 10 to about amino acid 20 of a FIG. 2 protein, polypeptides consisting of about amino acid 20 to about amino acid 30 of a FIG. 2 protein, polypeptides consisting of about amino acid 30 to about amino acid 40 of a FIG. 2 protein, polypeptides consisting of about amino acid 40 to about amino acid 50 of a FIG. 2 protein, polypeptides consisting of about amino acid 50 to about amino acid 60 of a FIG. 2 protein, polypeptides consisting of about amino acid 60 to about amino acid 70 of a FIG. 2 protein, polypeptides consisting of about amino acid 70 to about amino acid 80 of a FIG. 2 protein, polypeptides consisting of about amino acid 80 to about amino acid 90 of a FIG. 2 protein, polypeptides consisting of about amino acid 90 to about amino acid 100 of a FIG. 2 protein, etc. throughout the entirety of a protein set forth in FIG. 2 amino acid sequence. Moreover, polypeptides consisting of about amino acid 1 (or 20 or 30 or 40 etc.) to about amino acid 20, (or 130, or 140 or 150 etc.) of a FIG. 2 protein are embodiments of the invention. It is to be appreciated that the starting and stopping positions in this paragraph refer to the specified position as well as that position plus or minus 5 residues.

FIG. 2-*related* proteins are generated using standard peptide synthesis technology or using chemical cleavage methods well known in the art. Alternatively, recombinant methods can be used to generate nucleic acid molecules that encode a FIG. 2-*related* protein. In one embodiment, nucleic acid molecules provide a means to generate defined fragments of a FIG. 2 protein (or variants, homologs or analogs thereof).

III.A.) Motif-Bearing Protein Embodiments

Additional illustrative embodiments of the invention disclosed herein include polypeptides of the invention that comprise the amino acid residues of one or more of the biological motifs contained within a protein of FIG. 2 polypeptide sequence set forth in FIG. 2 or FIG. 3. Various motifs are known in the art, and a protein can be evaluated for the presence of such motifs by a number of publicly available Internet sites. Accordingly, see, e.g., the motif bearing subsequences of all FIG. 2 proteins set forth and identified in Tables V to XVIII, Table XX, Table XXI, and Tables XXIII to XXVI. Additionally, Table XIX sets forth several frequently occurring motifs based on pfam searches. The columns of Table VIII list (1) motif name abbreviation, (2) percent identity found amongst the different member of the motif family, (3) motif name or description and (4) most common function; location information is included if the motif is relevant for location.

Polypeptides comprising one or more of the motifs set forth in Tables V to XVIII, Table XX, Table XXI, and Tables XXIII to XXVI are useful in elucidating the specific characteristics of a malignant phenotype in view of the observation that the motifs discussed above are associated with growth dysregulation and because the proteins of FIG. 2 are overexpressed in certain cancers (See, e.g., Table I). Casein kinase II, cAMP and camp-dependent protein kinase, and Protein Kinase C, for example, are enzymes known to be associated with the development of the malignant phenotype (see e.g. Chen et al., Lab Invest., 78(2): 165-174 (1998); Gaiddon et al., Endocrinology 136(10): 4331-4338 (1995); Hall et al., Nucleic Acids Research 24(6): 1119-1126 (1996); Peterziel et al., Oncogene 18(46): 6322-6329 (1999) and O'Brian, Oncol. Rep. 5(2): 305-309 (1998)). Moreover, both glycosylation and myristoylation are protein modifications also associated with cancer and cancer progression (see e.g. Dennis et al., Biochem. Biophys. Acta 1473(1):21-34 (1999); Raju et al., Exp. Cell Res. 235(1): 145-154 (1997)). Amidation is another protein modification also associated with cancer and cancer progression (see e.g. Treston et al., J. Natl. Cancer Inst. Monogr. (13): 169-175 (1992)).

In another embodiment, proteins of the invention comprise one or more of the immunoreactive epitopes identified in accordance with art-accepted methods, such as the peptides set forth in Tables V-XVIII and XXIII to XXVI. CTL epitopes can be determined using specific algorithms to identify peptides within a FIG. 2 protein that are capable of optimally binding to specified HLA alleles. Moreover, processes for identifying peptides that have sufficient binding affinity for HLA molecules and which are correlated with being immunogenic epitopes, are well known in the art, and are carried out without undue experimentation. In addition, processes for identifying peptides that are immunogenic epitopes, are well known in the art, and are carried out without undue experimentation either in vitro or in vivo.

Also known in the art are principles for creating analogs of such epitopes in order to modulate immunogenicity. For example, one begins with an epitope that bears a CTL or HTL motif (see, e.g., the HLA Class I and HLA Class II motifs/supermotifs of Table IV). The epitope is analoged by substituting out an amino acid at one of the specified positions, and replacing it with another amino acid specified for that position. For example, one can substitute out a deleterious residue in favor of any other residue, such as a preferred residue as defined in Table IV; substitute a less-preferred residue with a preferred residue as defined in Table IV; or substitute an originally-occurring preferred residue with another preferred residue as defined in Table IV. Substitutions can occur at primary anchor positions or at other positions in a peptide; see, e.g., Table IV.

A variety of references reflect the art regarding the identification and generation of epitopes in a protein of interest as well as analogs thereof. See, for example, WO 9733602 to Chesnut et al.; Sette, Immunogenetics 1999 50(3-4): 201-212; Sette et al., J. Immunol. 2001 166(2): 1389-1397; Sidney et al., Hum. Immunol. 1997 58(1): 12-20; Kondo et al., Immunogenetics 1997 45(4): 249-258; Sidney et al., J. Immunol. 1996 157(8): 3480-90; and Falk et al., Nature 351: 290-6 (1991); Hunt et al., Science 255:1261-3 (1992); Parker et al., J. Immunol. 149:3580-7 (1992); Parker et al., J. Immunol. 152:163-75 (1994)); Kast et al., 1994 152(8): 3904-12; Borras-Cuesta et al., Hum. Immunol. 2000 61(3): 266-278; Alexander et al., J. Immunol. 2000 164(3); 164(3): 1625-1633; Alexander et al., PMID: 7895164, UI: 95202582; O'Sullivan et al., J. Immunol. 1991 147(8): 2663-2669; Alexander et al., Immunity 1994 1(9): 751-761 and Alexander et al., Immunol. Res. 1998 18(2): 79-92.

Related embodiments of the inventions include polypeptides comprising combinations of the different motifs set forth in Table XIX; and/or, one or more of the predicted CTL epitopes of Tables V to XVIII, and/or, one or more of the predicted HTL epitopes of Tables XXIII to XXVI and/or, one or more of the T cell binding motifs known in the art. Preferred embodiments contain no insertions, deletions or substitutions either within the motifs or the intervening sequences of the polypeptides. In addition, embodiments which include a number of either N-terminal and/or C-terminal amino acid residues on either side of these motifs may be desirable (to, for example, include a greater portion of the polypeptide architecture in which the motif is located). Typically the number of N-terminal and/or C-terminal amino acid residues on either side of a motif is between about 1 to about 100 amino acid residues, preferably 5 to about 50 amino acid residues.

FIG. 2-*related* proteins are embodied in many forms, preferably in isolated form. A purified FIG. 2 protein molecule will be substantially free of other proteins or molecules that impair the binding of a protein of FIG. 2 to an antibody, T cell or other ligand. The nature and degree of isolation and purification will depend on the intended use. Embodiments of FIG. 2-*related* proteins include purified FIG. 2-*related* proteins and functional, soluble FIG. 2-*related* proteins. In one embodiment, a functional, soluble FIG. 2 protein or fragment thereof retains the ability to be bound by an antibody, T cell or other ligand.

The invention also provides FIG. 2 proteins comprising biologically active fragments of a FIG. 2 amino acid sequence. Such proteins exhibit properties of the starting FIG. 2 protein, such as the ability to elicit the generation of antibodies that specifically bind an epitope associated with the starting FIG. 2 protein; to be bound by such antibodies; to elicit the activation of HTL or CTL; and/or, to be recognized by HTL or CTL that also specifically bind to the starting protein.

FIG. 2-*related* polypeptides that contain particularly interesting structures can be predicted and/or identified using various analytical techniques well known in the art, including, for example, the methods of Chou-Fasman, Garnier-Robson, Kyte-Doolittle, Eisenberg, Karplus-Schultz or Jameson-Wolf analysis, or on the basis of immunogenicity. Fragments that contain such structures are particularly useful in generating subunit-specific antibodies that bind to a protein of FIG. 2, or T cells or in identifying cellular factors that bind to a protein set forth in FIG. 2. For example, hydrophilicity profiles can be generated, and immunogenic peptide fragments identified, using the method of Hopp, T. P. and Woods, K. R., 1981, Proc. Natl. Acad. Sci. U.S.A. 78:3824-3828. Hydropathicity profiles can be generated, and immunogenic peptide fragments identified, using the method of Kyte, J. and Doolittle, R. F., 1982, J. Mol. Biol. 157:105-132. Percent (%) Accessible Residues profiles can be generated, and immunogenic peptide fragments identified, using the method of Janin J., 1979, Nature 277:491-492. Average Flexibility profiles can be generated, and immunogenic peptide fragments identified, using the method of Bhaskaran R., Ponnuswamy P. K., 1988, Int. J. Pept. Protein Res. 32:242-255. Beta-turn profiles can be generated, and immunogenic peptide fragments identified, using the method of Deleage, G., Roux B., 1987, Protein Engineering 1:289-294.

CTL epitopes can be determined using specific algorithms to identify peptides within a FIG. 2 protein that are capable of optimally binding to specified HLA alleles. Illustrating this, peptide epitopes from the proteins set forth in FIG. 2 that are presented in the context of human MHC class I molecules HLA-A1, A2, A3, A11, A24, B7 and B35 were predicted (Tables V-XVIII). Specifically, the complete amino acid sequence of a FIG. 2 protein and relevant portions of other presented variants, i.e., for HLA Class I predictions 9 flanking residues on either side of a point mutation for 10-mers, and for HLA Class II predictions 14 flanking residues on either side of a point mutation for 15-mers, were entered into the HLA Peptide Motif Search algorithm; for HLA Class II SYFPEITHI was used for HTL epitopes of Tables XXIII to XXVI.

The HLA peptide motif search algorithm was developed by Dr. Ken Parker based on binding of specific peptide sequences in the groove of HLA Class I molecules, in particular HLA-A2 (see, e.g., Falk et al., Nature 351: 290-6 (1991); Hunt et al., Science 255:1261-3 (1992); Parker et al., J. Immunol. 149:3580-7 (1992); Parker et al., J. Immunol. 152:163-75 (1994)). This algorithm allows location and ranking of 8-mer, 9-mer, and 10-mer peptides from a complete protein sequence for predicted binding to HLA-A2 as well as numerous other HLA Class I molecules. Many HLA class I binding peptides are 8-, 9-, 10 or 11-mers. For example, for class I HLA-A2, the epitopes preferably contain a leucine (L) or methionine (M) at position 2 and a valine (V) or leucine (L) at the C-terminus (see, e.g., Parker et al., J. Immunol. 149: 3580-7 (1992)). Selected results from a complete protein sequence set forth in FIG. 2 that predicted binding peptides are shown in Tables V-XVII. In Tables V-XVIII, the top 50 ranking candidates, 9-mers and 10-mers, for each family member are shown along with their location, the amino acid sequence of each specific peptide, and an estimated binding score. The binding score corresponds to the estimated half time of dissociation of complexes containing the peptide at 37° C. at pH 6.5. Peptides with the highest binding score are predicted to be the most tightly bound to HLA Class I on the cell surface for the greatest period of time and thus represent the best immunogenic targets for T-cell recognition.

Actual binding of peptides to an HLA allele can be evaluated by stabilization of HLA expression on the antigen-processing defective cell line T2 (see, e.g., Xue et al., Prostate 30:73-8 (1997) and Peshwa et al., Prostate 36:129-38 (1998)). Immunogenicity of specific peptides can be evaluated in vitro by stimulation of CD8+ cytotoxic T lymphocytes (CTL) in the presence of antigen presenting cells such as dendritic cells.

It is to be appreciated that every epitope predicted by the BIMAS site, Epimer™ and Epimatrix™ sites, or specified by the HLA class I or class II motifs available in the art or which become part of the art such as set forth in Table IV are to be "applied" to a FIG. 2 protein in accordance with the invention. As used in this context "applied" means that a FIG. 2 protein is evaluated, e.g., visually or by computer-based patterns finding methods, as appreciated by those of skill in the relevant art. Every subsequence of a FIG. 2 protein of 8, 9, 10, or 11 amino acid residues that bears an HLA Class I motif, or a subsequence of 9 or more amino acid residues that bear an HLA Class II motif are within the scope of the invention.

III.B.) Expression of FIG. 2-R*elated* Proteins

In an embodiment described in the examples that follow, the proteins set forth in FIG. 2 can be conveniently expressed in cells (such as 293T cells) transfected with a commercially available expression vector such as a CMV-driven expression vector encoding a protein of FIG. 2 with a C-terminal 6×His and MYC tag (pcDNA3.1/mycHIS, Invitrogen or Tag5, GenHunter Corporation, Nashville Tenn.). The Tag5 vector provides an IgGK secretion signal that can be used to facilitate the production of a secreted FIG. 2 protein in transfected cells. A secreted HIS-tagged FIG. 2 protein in the culture media can be purified, e.g., using a nickel column using standard techniques.

III.C.) Modifications of FIG. 2-R*elated* Proteins

Modifications of FIG. 2-*related* proteins such as covalent modifications are included within the scope of this invention. One type of covalent modification includes reacting targeted amino acid residues of a protein of FIG. 2 polypeptide with an organic derivatizing agent that is capable of reacting with selected side chains or the N- or C-terminal residues of a FIG. 2 protein. Another type of covalent modification to a protein of FIG. 2 polypeptide included within the scope of this invention comprises altering the native glycosylation pattern of a protein of the invention. Another type of covalent modification to a protein of FIG. 2 comprises linking a FIG. 2 polypeptide to one of a variety of nonproteinaceous polymers, e.g., polyethylene glycol (PEG), polypropylene glycol, or polyoxyalkylenes, in the manner set forth in U.S. Pat. No. 4,640,835; 4,496,689; 4,301,144; 4,670,417; 4,791,192 or 4,179,337.

FIG. 2-*related* proteins of the present invention can also be modified to form a chimeric molecule comprising a protein of FIG. 2 fused to another, heterologous polypeptide or amino acid sequence. Such a chimeric molecule can be synthesized chemically or recombinantly. A chimeric molecule can have a protein of the invention fused to another tumor-associated antigen or fragment thereof. Alternatively, a protein in accordance with the invention can comprise a fusion of fragments of a FIG. 2 sequence (amino or nucleic acid) such that a molecule is created that is not, through its length, directly homologous to the amino or nucleic acid sequences shown in FIG. 2 or FIG. 3. Such a chimeric molecule can comprise multiples of the same subsequence of a protein set forth in FIG. 2. A chimeric molecule can comprise a fusion of a FIG. 2-*related* protein with a polyhistidine epitope tag, which provides an epitope to which immobilized nickel can selectively bind, with cytokines or with growth factors. The epitope tag is generally placed at the amino- or carboxyl-terminus of a FIG. 2 protein. In an alternative embodiment, the chimeric molecule can comprise a fusion of a FIG. 2-*related* protein with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of a FIG. 2 polypeptide in place of at least one variable region within an Ig molecule. In a preferred embodiment, the immunoglobulin fusion includes the hinge, CH2 and CH3, or the hinge, CH1, CH2 and CH3 regions of an IgG1 molecule. For the production of immunoglobulin fusions see, e.g., U.S. Pat. No. 5,428,130 issued Jun. 27, 1995.

III.D.) Uses of FIG. 2-R*elated* Proteins

The proteins of the invention have a number of different specific uses. As the proteins set forth in FIG. 2 are highly expressed in one or more cancers, FIG. 2-*related* proteins are used in methods that assess the status of FIG. 2 gene products in normal versus cancerous tissues, thereby elucidating the malignant phenotype. Typically, polypeptides from specific regions of a FIG. 2 protein are used to assess the presence of perturbations (such as deletions, insertions, point mutations etc.) in those regions (such as regions containing one or more motifs). Exemplary assays utilize antibodies or T cells targeting FIG. 2-*related* proteins comprising the amino acid residues of one or more of the biological motifs contained within a protein of FIG. 2 polypeptide sequence in order to evaluate the characteristics of this region in normal versus cancerous tissues or to elicit an immune response to the epitope. Alternatively, FIG. 2-*related* proteins that contain the amino acid residues of one or more of the biological motifs in a FIG. 2 protein are used to screen for factors that interact with that region of the respective protein set forth in FIG. 2.

FIG. 2 protein fragments/subsequences are particularly useful in generating and characterizing domain-specific antibodies (e.g., antibodies recognizing an extracellular or intracellular epitope of a FIG. 2 protein), for identifying agents or cellular factors that bind to a protein in FIG. 2 or a particular structural domain thereof, and in various therapeutic and diagnostic contexts, including but not limited to diagnostic assays, cancer vaccines and methods of preparing such vaccines.

Proteins encoded by a gene of the invention (e.g., a FIG. 2 gene, or analog, homolog or fragment thereof) have a variety of uses, including but not limited to generating antibodies and in methods for identifying ligands and other agents and cellular constituents that bind to a FIG. 2 gene product. Antibodies raised against a FIG. 2 protein or fragment thereof are useful in diagnostic and prognostic assays, and imaging methodologies in the management of human cancers characterized by expression of a FIG. 2 protein, such as those listed in Table I. Such antibodies can be expressed intracellularly and used in methods of treating patients with such cancers. FIG. 2-*related* nucleic acids or proteins are also used in generating HTL or CTL responses.

Various immunological assays useful for the detection of FIG. 2 proteins are used, including but not limited to various types of radioimmunoassays, enzyme-linked immunosorbent assays (ELISA), enzyme-linked immunofluorescent assays (ELIFA), immunocytochemical methods, and the like. Antibodies can be labeled and used as immunological imaging reagents capable of detecting cells that express a protein set forth in FIG. 2 (e.g., in radioscintigraphic imaging methods). FIG. 2 proteins are also particularly useful in generating cancer vaccines, as further described herein.

IV.) Antibodies of the Invention

Another aspect of the invention provides antibodies that bind to FIG. 2-*related* proteins. Preferred antibodies specifically bind to a FIG. 2-*related* protein and do not bind (or bind weakly) to peptides or proteins that are not FIG. 2-*related* proteins. For example, antibodies that bind to proteins in FIG. 2 can bind to FIG. 2-*related* proteins such as the homologs or analogs thereof.

Antibodies of the invention are particularly useful in cancer (see, e.g., the cancers referred to in Table I) diagnostic and prognostic assays, and imaging methodologies. Similarly, such antibodies are useful in the treatment, diagnosis, and/or prognosis of other cancers, to the extent the genes and respective encoded proteins set forth in FIG. 2 are also expressed or overexpressed in these other cancers. Moreover, intracellularly expressed antibodies (e.g., single chain antibodies) are therapeutically useful in treating cancers in which the expression of a gene and encoded protein of FIG. 2 is involved, such as advanced or metastatic prostate cancers.

The invention also provides various immunological assays useful for the detection and quantification a protein of FIG. 2 and mutants thereof. Such assays can comprise one or more FIG. 2 antibodies capable of recognizing and binding a FIG. 2-*related* protein, as appropriate. These assays are performed within various immunological assay formats well known in the art, including but not limited to various types of radioimmunoassays, enzyme-linked immunosorbent assays (ELISA), enzyme-linked immunofluorescent assays (ELIFA), and the like.

Immunological non-antibody assays of the invention also comprise T cell immunogenicity assays (inhibitory or stimulatory) as well as major histocompatibility complex (MHC) binding assays.

In addition, immunological imaging methods capable of detecting a cancer expressing a gene of the invention are also provided by the invention, including but not limited to radioscintigraphic imaging methods using labeled FIG. 2 antibodies. Such assays are clinically useful in the detection, monitoring, and prognosis of a gene of the invention-expressing cancer.

Antibodies of the invention are also used in methods for purifying a FIG. 2-*related* protein and for isolating proteins of the invention, e.g., FIG. 2 homologues and related molecules. For example, a method of purifying a FIG. 2-*related* protein comprises incubating a FIG. 2 antibody, which has been coupled to a solid matrix, with a lysate or other solution containing a FIG. 2-*related* protein under conditions that permit the antibody to bind to the FIG. 2-*related* protein; washing the solid matrix to eliminate impurities; and eluting the FIG. 2-*related* protein from the coupled antibody. Other uses of antibodies in accordance with the invention include generating anti-idiotypic antibodies that mimic a FIG. 2 protein.

Various methods for the preparation of antibodies are well known in the art. For example, antibodies can be prepared by immunizing a suitable mammalian host using a FIG. 2-*related* protein, peptide, or fragment, in isolated or immunoconjugated form (Antibodies: A Laboratory Manual, CSH Press, Eds., Harlow, and Lane (1988); Harlow, Antibodies, Cold Spring Harbor Press, NY (1989)). In addition, fusion proteins in accordance with the invention can also be used, such as a protein of FIG. 2 GST-fusion protein. In a particular embodiment, a GST fusion protein comprising all or most of the amino acid sequence of FIG. 2 or FIG. 3 is produced, then used as an immunogen to generate appropriate antibodies. In another embodiment, a FIG. 2-*related* protein is synthesized and used as an immunogen.

In addition, naked DNA immunization techniques known in the art are used (with or without a purified FIG. 2-*related* protein or agene of FIG. 2-*expressing* cells) to generate an immune response to the encoded immunogen (for review, see Donnelly et al., 1997, Ann. Rev. Immunol. 15: 617-648).

The amino acid sequence of a FIG. 2 protein can be analyzed to select specific regions of the protein for generating antibodies. For example, hydrophobicity and hydrophilicity analyses of FIG. 2 amino acid sequences are used to identify hydrophilic regions in the protein. Regions of a FIG. 2 protein that show immunogenic structure, as well as other regions and domains, can readily be identified using various other methods known in the art, such as Chou-Fasman, Garnier-Robson, Kyte-Doolittle, Eisenberg, Karplus-Schultz or Jameson-Wolf analysis. Hydrophilicity profiles can be generated using the method of Hopp, T. P. and Woods, K. R., 1981, Proc. Natl. Acad. Sci. U.S.A. 78:3824-3828. Hydropathicity profiles can be generated using the method of Kyte, J. and Doolittle, R. F., 1982, J. Mol. Biol. 157:105-132. Percent (%) Accessible Residues profiles can be generated using the method of Janin J., 1979, Nature 277:491-492. Average Flexibility profiles can be generated using the method of Bhaskaran R., Ponnuswamy P. K., 1988, Int. J. Pept. Protein Res. 32:242-255. Beta-turn profiles can be generated using the method of Deleage, G., Roux B., 1987, Protein Engineering 1:289-294. Thus, each region identified by any of these programs or methods is within the scope of the present invention. Methods for the generation of antibodies in accordance with the invention are further illustrated by way of the Examples provided herein. Methods for preparing a protein or polypeptide for use as an immunogen are well known in the art. Also well known in the art are methods for preparing immunogenic conjugates of a protein with a carrier, such as BSA, KLH or other carrier protein. In some circumstances, direct conjugation using, for example, carbodiimide reagents are used; in other instances linking reagents such as those supplied by Pierce Chemical Co., Rockford, Ill., are effective. Administration of protein immunogen is often conducted by injection over a suitable time period and with use of a suitable adjuvant, as is understood in the art. During the immunization schedule, titers of antibodies can be taken to determine adequacy of antibody formation.

Monoclonal antibodies of the invention can be produced by various means well known in the art. For example, immortalized cell lines that secrete a desired monoclonal antibody are prepared using the standard hybridoma technology of Kohler and Milstein or modifications that immortalize antibody-producing B cells, as is generally known. Immortalized cell lines that secrete the desired antibodies are screened by immunoassay in which the antigen is a FIG. 2-*related* protein. When the appropriate immortalized cell culture is identified, the cells can be expanded and antibodies produced either from in vitro cultures or from ascites fluid.

The antibodies or fragments of the invention can also be produced, by recombinant means. Regions that bind specifically to the desired regions of a FIG. 2 protein can also be produced in the context of chimeric or complementarity-determining region (CDR) grafted antibodies of multiple species origin. Humanized or human antibodies that specifically bind to a proteins of FIG. 2 can also be produced, and are preferred for use in therapeutic contexts. Methods for humanizing murine and other non-human antibodies, by substituting one or more of the non-human antibody CDRs for corresponding human antibody sequences, are well known (see for example, Jones et al., 1986, Nature 321: 522-525; Riechmann et al., 1988, Nature 332: 323-327; Verhoeyen et al., 1988, Science 239: 1534-1536). See also, Carter et al., 1993, Proc. Natl. Acad. Sci. USA 89: 4285 and Sims et al., 1993, J. Immunol. 151: 2296.

Methods for producing fully human monoclonal antibodies include phage display and transgenic methods (for review, see Vaughan et al., 1998, Nature Biotechnology 16: 535-539). Fully human monoclonal antibodies of the invention can be generated using cloning technologies employing large human Ig gene combinatorial libraries (i.e., phage display) (Griffiths and Hoogenboom, Building an in vitro immune system: human antibodies from phage display libraries. In: Protein Engineering of Antibody Molecules for Prophylactic and Therapeutic Applications in Man, Clark, M. (Ed.), Nottingham Academic, pp 45-64 (1993); Burton and Barbas, Human Antibodies from combinatorial libraries. Id., pp 65-82). Fully human monoclonal antibodies of the invention can also be produced using transgenic mice engineered to contain human immunoglobulin gene loci as described in PCT Patent Application WO98/24893, Kucherlapati and Jakobovits et al., published Dec. 3, 1997 (see also, Jakobovits, 1998, Exp. Opin. Invest. Drugs 7(4): 607-614; U.S. Pat. No. 6,162,963 issued 19 Dec. 2000; U.S. Pat. No. 6,150,584 issued 12 Nov. 2000; and, U.S. Pat. No. 6,114,598 issued 5 Sep. 2000). This method avoids the in vitro manipulation required with phage display technology and efficiently produces high affinity authentic human antibodies.

Reactivity of antibodies of the invention with a FIG. 2-*related* protein can be established by a number of well known means, including Western blot, immunoprecipitation, ELISA, and FACS analyses using, as appropriate, FIG. 2-*related* proteins, or protein of FIG. 2-*expressing* cells or extracts thereof. An FIG. 2 antibody of the invention, or fragment thereof, can be labeled with a detectable marker or conjugated to a second molecule. Suitable detectable markers include, but are not limited to, a radioisotope, a fluorescent compound, a bioluminescent compound, chemiluminescent compound, a metal chelator or an enzyme. Further, bi-specific antibodies specific for two or more epitopes are generated using methods generally known in the art. Homodimeric antibodies can also be generated by cross-linking techniques known in the art (e.g., Wolff et al., Cancer Res. 53: 2560-2565).

V.) Cellular Immune Responses of the Invention

The mechanism by which T cells recognize antigens has been delineated. Efficacious peptide epitope vaccine compositions of the invention induce a therapeutic or prophylactic immune responses in very broad segments of the world-wide population. For an understanding of the value and efficacy of compositions of the invention that induce cellular immune responses, a brief review of immunology-related technology is provided.

A complex of an HLA molecule and a peptidic antigen acts as the ligand recognized by HLA-restricted T cells (Buus, S. et al., *Cell* 47:1071, 1986; Babbitt, B. P. et al., *Nature* 317: 359, 1985; Townsend, A. and Bodmer, H., *Annu. Rev. Immunol.* 7:601, 1989; Germain, R. N., *Annu. Rev. Immunol.* 11:403, 1993). Through the study of single amino acid substituted antigen analogs and the sequencing of endogenously bound, naturally processed peptides, critical residues that correspond to motifs required for specific binding to HLA antigen molecules have been identified and are set forth in Table IV (see also, e.g., Southwood, et al., *J. Immunol.* 160: 3363, 1998; Rammensee, et al., *Immunogenetics* 41:178, 1995; Sette, A. and Sidney, *J. Curr. Opin. Immunol.* 10:478, 1998; Engelhard, V. H., *Curr. Opin. Immunol.* 6:13, 1994; Sette, A. and Grey, H. M., *Curr. Opin. Immunol.* 4:79, 1992; Sinigaglia, F. and Hammer, *J. Curr. Biol.* 6:52, 1994; Ruppert et al., *Cell* 74:929-937, 1993; Kondo et al., *J. Immunol.* 155: 4307-4312, 1995; Sidney et al., *J. Immunol.* 157:3480-3490, 1996; Sidney et al., *Human Immunol.* 45:79-93, 1996; Sette, A. and Sidney, *J. Immunogenetics* 1999 November; 50(3-4): 201-12, Review).

Furthermore, x-ray crystallographic analyses of HLA-peptide complexes have revealed pockets within the peptide binding cleft/groove of HLA molecules which accommodate, in an allele-specific mode, residues borne by peptide ligands; these residues in turn determine the HLA binding capacity of the peptides in which they are present. (See, e.g., Madden, D. R. *Annu. Rev. Immunol.* 13:587, 1995; Smith, et al., *Immunity* 4:203, 1996; Fremont et al., *Immunity* 8:305, 1998; Stern et al., *Structure* 2:245, 1994; Jones, E. Y. *Curr. Opin. Immunol.* 9:75, 1997; Brown, J. H. et al., *Nature* 364:33, 1993; Guo, H. C. et al., *Proc. Natl. Acad. Sci. USA* 90:8053, 1993; Guo, H. C. et al., *Nature* 360:364, 1992; Silver, M. L. et al., *Nature* 360:367, 1992; Matsumura, M. et al., *Science* 257:927, 1992; Madden et al., *Cell* 70:1035, 1992; Fremont, D. H. et al., *Science* 257:919, 1992; Saper, M. A., Bjorkman, P. J. and Wiley, D. C., *J. Mol. Biol.* 219:277, 1991.)

Accordingly, the definition of class I and class II allele-specific HLA binding motifs, or class I or class II supermotifs allows identification of regions within a protein that are correlated with binding to particular HLA antigen(s).

Thus, by a process of HLA motif identification, candidates for epitope-based vaccines have been identified; such candidates can be further evaluated by HLA-peptide binding assays to determine binding affinity and/or the time period of association of the epitope and its corresponding HLA molecule. Additional confirmatory work can be performed to select, amongst these vaccine candidates, epitopes with preferred characteristics in terms of population coverage, and/or immunogenicity.

Various strategies can be utilized to evaluate cellular immunogenicity, including:

1) Evaluation of primary T cell cultures from normal individuals (see, e.g. Wentworth, P. A. et al., *Mol. Immunol.* 32:603, 1995; Celis, E. et al., *Proc. Natl. Acad. Sci. USA* 91:2105, 1994; Tsai, V. et al., *J. Immunol.* 158:1796, 1997; Kawashima, I. et al., *Human Immunol.* 59:1, 1998). This procedure involves the stimulation of peripheral blood lymphocytes (PBL) from normal subjects with a test peptide in the presence of antigen presenting cells in vitro over a period of several weeks. T cells specific for the peptide become activated during this time and are detected using, e.g., a lymphokine- or $^{51}$Cr-release assay involving peptide sensitized target cells.

2) Immunization of HLA transgenic mice (see, e.g., Wentworth, P. A. et al., *J. Immunol.* 26:97, 1996; Wentworth, P. A. et al., *Int. Immunol* 8:651, 1996; Alexander, J. et al., *J. Immunol.* 159:4753, 1997). For example, in such methods peptides in incomplete Freund's adjuvant are administered subcutaneously to HLA transgenic mice. Several weeks following immunization, splenocytes are removed and cultured in vitro in the presence of test peptide for approximately one week. Peptide-specific T cells are detected using, e.g., a $^{51}$Cr-release assay involving peptide sensitized target cells and target cells expressing endogenously generated antigen.

3) Demonstration of recall T cell responses from immune individuals who have been either effectively vaccinated and/or from chronically ill patients (see, e.g. Rehermann, B. et al., *J. Exp. Med.* 181:1047, 1995; Doolan, D. L. et al., *Immunity* 7:97, 1997; Bertoni, R. et al., *J. Clin. Invest.* 100:503, 1997; Threlkeld, S. C. et al., *J. Immunol.* 159:1648, 1997; Diepolder, H. M. et al., *J. Virol.* 71:6011, 1997). Accordingly, recall responses are detected by culturing PBL from subjects that have been exposed to the antigen due to disease and thus have generated an immune response "naturally", or from patients who were vaccinated against the antigen. PBL from subjects are cultured in vitro for 1-2 weeks in the presence of test peptide plus antigen presenting cells (APC) to allow activation of "memory" T cells, as compared to "naive" T cells. At the end of the culture period, T cell activity is detected using assays including $^{51}$Cr release involving peptide-sensitized targets, T cell proliferation, or lymphokine release.

VI.) Transgenic Animals of the Invention

Nucleic acids that encode a FIG. 2-*related* protein can also be used to generate either transgenic animals or "knock out" animals that, in turn, are useful in the development and screening of therapeutically useful reagents. In accordance with established techniques, cDNA encoding a protein of FIG. 2 can be used to clone genomic DNA that encodes a protein of FIG. 2. The cloned genomic sequences can then be used to generate transgenic animals containing cells that express DNA that encode a FIG. 2 protein. Methods for generating transgenic animals, particularly animals such as mice or rats, have become conventional in the art and are described, for example, in U.S. Pat. No. 4,736,866 issued 12 Apr. 1988, and U.S. Pat. No. 4,870,009 issued 26 Sep. 1989. Typically, particular cells would be targeted for a nucleic acid sequence of FIG. 2 transgene incorporation with tissue-specific enhancers.

Transgenic animals that include a copy of a transgene encoding a FIG. 2 protein can be used to examine the effect of increased expression of DNA that encodes the FIG. 2 protein. Such animals can be used as tester animals for reagents thought to confer protection from, for example, pathological conditions associated with its overexpression. In accordance with this aspect of the invention, an animal is treated with a reagent and a reduced incidence of a pathological condition, compared to untreated animals that bear the transgene, would indicate a potential therapeutic intervention for the pathological condition.

Alternatively, non-human homologues of FIG. 2 proteins can be used to construct a FIG. 2 protein "knock out" animal that has a defective or altered gene encoding the FIG. 2 protein as a result of homologous recombination between the endogenous gene encoding the FIG. 2 protein and altered genomic DNA encoding the FIG. 2 protein, introduced into an embryonic cell of the animal. For example, cDNA that encodes a FIG. 2 protein can be used to clone genomic DNA encoding the FIG. 2 protein, in accordance with established techniques. A portion of the genomic DNA encoding a FIG. 2 protein can be deleted or replaced with another gene, such as a gene encoding a selectable marker that can be used to monitor integration. Typically, several kilobases of unaltered flanking DNA (both at the 5' and 3' ends) are included in the vector (see, e.g., Thomas and Capecchi, *Cell,* 51:503 (1987) for a description of homologous recombination vectors). The vector is introduced into an embryonic stem cell line (e.g., by electroporation) and cells in which the introduced DNA has homologously recombined with the endogenous DNA are selected (see, e.g., Li et al., *Cell,* 69:915 (1992)). The selected cells are then injected into a blastocyst of an animal (e.g., a mouse or rat) to form aggregation chimeras (see, e.g., Bradley, in *Teratocarcinomas and Embryonic Stem Cells: A Prac-*

*tical Approach*, E. J. Robertson, ed. (IRL, Oxford, 1987), pp. 113-152). A chimeric embryo can then be implanted into a suitable pseudopregnant female foster animal, and the embryo brought to term to create a “knock out” animal. Progeny harboring the homologously recombined DNA in their germ cells can be identified by standard techniques and used to breed animals in which all cells of the animal contain the homologously recombined DNA. Knock out animals can be characterized, for example, for their ability to defend against certain pathological conditions or for their development of pathological conditions due to absence of a protein of FIG. 2.

VII.) Methods for the Detection of a Gene or Protein of the Invention

Another aspect of the present invention relates to methods for detecting FIG. 2 polynucleotides and FIG. 2-*related* proteins, as well as methods for identifying a cell that expresses a gene set forth in FIG. 2. The expression profile of a gene or protein set forth in FIG. 2 makes it a diagnostic marker for metastasized disease. Accordingly, the status of FIG. 2 gene products provides information useful for predicting a variety of factors including susceptibility to advanced stage disease, rate of progression, and/or tumor aggressiveness. As discussed in detail herein, the status of FIG. 2 gene products in patient samples can be analyzed by a variety protocols that are well known in the art including immunohistochemical analysis, the variety of Northern blotting techniques including in situ hybridization, RT-PCR analysis (for example on laser capture micro-dissected samples), Western blot analysis and tissue array analysis.

More particularly, the invention provides assays for the detection of FIG. 2 polynucleotides in a biological sample, such as serum, bone, prostate, and other tissues, urine, semen, cell preparations, and the like. Detectable FIG. 2 polynucleotides include, for example, a FIG. 2 gene or fragment thereof, a FIG. 2 mRNA, alternative splice variants of FIG. 2 mRNAs, and recombinant DNA or RNA molecules that contain a FIG. 2 polynucleotide. A number of methods for amplifying and/or detecting the presence of FIG. 2 polynucleotides are well known in the art and can be employed in the practice of this aspect of the invention.

In one embodiment, a method for detecting an a FIG. 2 mRNA in a biological sample comprises producing cDNA from the sample by reverse transcription using at least one primer; amplifying the cDNA so produced using FIG. 2 polynucleotides as sense and antisense primers to amplify FIG. 2 cDNAs therein; and detecting the presence of the amplified FIG. 2 cDNA. Optionally, the sequence of the amplified FIG. 2 cDNA can be determined.

In another embodiment, a method of detecting a FIG. 2 gene in a biological sample comprises first isolating genomic DNA from the sample; amplifying the isolated genomic DNA using FIG. 2 polynucleotides as sense and antisense primers; and detecting the presence of the amplified FIG. 2 gene. Any number of appropriate sense and antisense probe combinations can be designed from a FIG. 2 nucleotide sequence and used for this purpose.

The invention also provides assays for detecting the presence of a FIG. 2 protein in a tissue or other biological sample such as serum, semen, bone, prostate, urine, cell preparations, and the like. Methods for detecting a FIG. 2-*related* protein are also well known and include, for example, immunoprecipitation, immunohistochemical analysis, Western blot analysis, molecular binding assays, ELISA, ELIFA and the like. For example, a method of detecting the presence of a FIG. 2-*related* protein in a biological sample comprises first contacting the sample with a FIG. 2 antibody, a FIG. 2-*reactive* fragment thereof, or a recombinant protein containing an antigen binding region of a FIG. 2 antibody; and then detecting the binding of a FIG. 2-*related* protein in the sample.

Methods for identifying a cell that expresses a gene of FIG. 2 are also within the scope of the invention. In one embodiment, an assay for identifying a cell that expresses a FIG. 2 gene comprises detecting the presence of a FIG. 2 mRNA in the cell. Methods for the detection of particular mRNAs in cells are well known and include, for example, hybridization assays using complementary DNA probes (such as in situ hybridization using labeled riboprobes to a gene of FIG. 2, Northern blot and related techniques) and various nucleic acid amplification assays (such as RT-PCR using complementary primers specific for genes of FIG. 2, and other amplification type detection methods, such as, for example, branched DNA, SISBA, TMA and the like). Alternatively, an assay for identifying a cell that expresses a FIG. 2 gene comprises detecting the presence of a FIG. 2-*related* protein in the cell or secreted by the cell. Various methods for the detection of proteins are well known in the art and are employed for the detection of FIG. 2-*related* proteins and cells that express FIG. 2-*related* proteins.

Expression analysis of FIG. 2 proteins is also useful as a tool for identifying and evaluating agents that modulate FIG. 2 gene expressions. For example, FIG. 2 gene expression is significantly upregulated in prostate cancer, and is expressed in cancers of the tissues listed in Table I. Identification of a molecule or biological agent that inhibits FIG. 2 gene expression or over-expression in cancer cells is of therapeutic value. For example, such an agent can be identified by using a screen that quantifies a FIG. 2 gene expression by RT-PCR, nucleic acid hybridization or antibody binding.

VIII.) Methods for Monitoring the Status of Genes and Proteins of the Invention

Oncogenesis is known to be a multistep process where cellular growth becomes progressively dysregulated and cells progress from a normal physiological state to precancerous and then cancerous states (see, e.g., Alers et al., Lab Invest. 77(5): 437-438 (1997) and Isaacs et al., Cancer Surv. 23: 19-32 (1995)). In this context, examining a biological sample for evidence of dysregulated cell growth (such as aberrant gene of FIG. 2 expression in cancers) allows for early detection of such aberrant physiology, before a pathologic state such as cancer has progressed to a stage that therapeutic options are more limited and or the prognosis is worse. In such examinations, the status of the genes and proteins in FIG. 2 in a biological sample of interest can be compared, for example, to the status of that gene and/or protein of FIG. 2 in a corresponding normal sample (e.g. a sample from that individual or alternatively another individual that is not affected by a pathology). An alteration in the status of a gene and/or protein of FIG. 2 in the biological sample (as compared to the normal sample) provides evidence of dysregulated cellular growth. In addition to using a biological sample that is not affected by a pathology as a normal sample, one can also use a predetermined normative value such as a predetermined normal level of mRNA expression (see, e.g., Grever et al., J. Comp. Neurol. 1996 Dec. 9; 376(2): 306-14 and U.S. Pat. No. 5,837,501) to compare the status of a gene or protein in a sample.

The term “status” in this context is used according to its art accepted meaning and refers to the condition or state of a gene and its products. Typically, skilled artisans use a number of parameters to evaluate the condition or state of a gene and its products. These include, but are not limited to the location of expressed gene products (including the location of gene of FIG. 2 expressing cells) as well as the level, and biological activity of expressed gene products (such as FIG. 2 mRNA, polynucleotides and polypeptides). Typically, an alteration in the status of a gene and/or protein of FIG. 2 comprises a change in the location of a protein FIG. 2 and/or cells that express a protein of FIG. 2 and/or an increase in FIG. 2 mRNA and/or protein expression.

The status in a sample of a gene or protein of FIG. 2 can be analyzed by a number of means well known in the art, including without limitation, immunohistochemical analysis, in situ hybridization, RT-PCR analysis on laser capture micro-dissected samples, Western blot analysis, and tissue array analysis. Typical protocols for evaluating the status of a FIG. 2 gene and gene product are found, for example in Ausubel et al. eds., 1995, Current Protocols In Molecular Biology, Units 2 (Northern Blotting), 4 (Southern Blotting), 15 (Immunoblotting) and 18 (PCR Analysis). Thus, the status of a gene or protein in FIG. 2 in a biological sample is evaluated by various methods utilized by skilled artisans including, but not limited to genomic Southern analysis (to examine, for example perturbations in a FIG. 2 gene), Northern analysis and/or PCR analysis of FIG. 2 mRNA (to examine, for example alterations in the polynucleotide sequences or expression levels of FIG. 2 mRNAs), and, Western and/or immunohistochemical analysis (to examine, for example alterations in polypeptide sequences, alterations in polypeptide localization within a sample, alterations in expression levels of FIG. 2 proteins and/or associations of FIG. 2 proteins with polypeptide binding partners). Detectable FIG. 2 polynucleotides include, for example, a FIG. 2 gene or fragment thereof, a FIG. 2 mRNA, alternative splice variants, FIG. 2 mRNAs, and recombinant DNA or RNA molecules containing a FIG. 2 polynucleotide.

The expression profile of each gene of FIG. 2 makes it a diagnostic marker for local and/or metastasized disease, and provides information on the growth or oncogenic potential of a biological sample. In particular, the status of agene or protein of FIG. 2 provides information useful for predicting susceptibility to particular disease stages, progression, and/or tumor aggressiveness. The invention provides methods and assays for determining the expression or mutational status of a gene of FIG. 2 and diagnosing cancers that express a gene of FIG. 2, such as cancers of the tissues listed in Table I. For example, because each gene of FIG. 2 mRNA is highly expressed in cancers relative to normal tissue, assays that evaluate the levels of FIG. 2 mRNA transcripts or proteins in a biological sample are used to diagnose a disease associated with dysregulation of a gene set forth in FIG. 2, and can provide prognostic information useful in defining appropriate therapeutic options.

The expression status of the genes and proteins set forth in FIG. 2 provides information including the presence, stage and location of dysplastic, precancerous and cancerous cells, predicting susceptibility to various stages of disease, and/or for gauging tumor aggressiveness. Moreover, the expression profile makes it useful as an imaging reagent for metastasized disease. Consequently, an aspect of the invention is directed to the various molecular prognostic and diagnostic methods for examining the status of these genes and proteins in biological samples such as those from individuals suffering from, or suspected of suffering from a pathology characterized by dysregulated cellular growth, such as cancer.

As described above, the status of the genes and proteins in FIG. 2 in a biological sample can be examined by a number of well-known procedures in the art. For example, the status of the genes and proteins in FIG. 2 in a biological sample taken from a specific location in the body can be examined by evaluating the sample for the presence or absence of a FIG. 2 protein expressing cells (e.g. those that express FIG. 2 mRNAs or proteins). This examination can provide evidence of dysregulated cellular growth, for example, when FIG. 2 protein-expressing cells are found in a biological sample that does not normally contain such cells (such as a lymph node), because such alterations in the status of the genes and proteins in FIG. 2 in a biological sample are often associated with dysregulated cellular growth. Specifically, one indicator of dysregulated cellular growth is the metastases of cancer cells from an organ of origin (such as the prostate) to a different area of the body (such as a lymph node). In this context, evidence of dysregulated cellular growth is important for example because occult lymph node metastases can be detected in a substantial proportion of patients with prostate cancer, and such metastases are associated with known predictors of disease progression (see, e.g., Murphy et al., Prostate 42(4): 315-317 (2000); Su et al., Semin. Surg. Oncol. 18(1): 17-28 (2000) and Freeman et al., J Urol 1995 August 154(2 Pt 1):474-8).

In one aspect, the invention provides methods for monitoring FIG. 2 gene products by determining the status of FIG. 2 gene products expressed by cells from an individual suspected of having a disease associated with dysregulated cell growth (such as hyperplasia or cancer) and then comparing the status so determined to the status of FIG. 2 gene products in a corresponding normal sample. The presence of aberrant FIG. 2 gene products in the test sample relative to the normal sample provides an indication of the presence of dysregulated cell growth within the cells of the individual.

In another aspect, the invention provides assays useful in determining the presence of cancer in an individual, comprising detecting a significant increase in FIG. 2 mRNA or protein expression in a test cell or tissue sample relative to expression levels in the corresponding normal cell or tissue. The presence of FIG. 2 mRNA can, for example, be evaluated in tissue samples including but not limited to those listed in Table I. The presence of significant FIG. 2 protein expression or overexpression in any of these tissues is useful to indicate the emergence, presence and/or severity of a cancer, where the corresponding normal tissues do not express FIG. 2 mRNA or express it at lower levels.

In a related embodiment, the genes and proteins in FIG. 2 status is determined at the protein level rather than at the nucleic acid level. For example, such a method comprises determining the level of a FIG. 2 protein expressed by cells in a test tissue sample and comparing the level so determined to the level of a FIG. 2 protein expressed in a corresponding normal sample. In one embodiment, the presence of a FIG. 2 protein is evaluated, for example, using immunohistochemical methods. Antibodies of the invention or binding partners capable of detecting a FIG. 2 protein expression are used in a variety of assay formats well known in the art for this purpose.

In a further embodiment, one can evaluate the status of FIG. 2 nucleotide and amino acid sequences in a biological sample in order to identify perturbations in the structure of these molecules. These perturbations can include insertions, deletions, substitutions and the like. Such evaluations are useful because perturbations in the nucleotide and amino acid sequences are observed in a large number of proteins associated with a growth dysregulated phenotype (see, e.g., Marrogi et al., 1999, J. Cutan. Pathol. 26(8):369-378). For example, a mutation in the sequence of a FIG. 2 gene can indicate the presence or promotion of a tumor. Such assays therefore have diagnostic and predictive value where a mutation in a FIG. 2 gene indicates a potential loss of function or increase in tumor growth.

A wide variety of assays for observing perturbations in nucleotide and amino acid sequences are well known in the art. For example, the size and structure of nucleic acid or amino acid sequences of FIG. 2, or the gene products of one of these genes are observed by the Northern, Southern, Western, PCR and DNA sequencing protocols as discussed herein. In addition, other methods for observing perturbations in nucleotide and amino acid sequences such as single strand conformation polymorphism analysis are well known in the art (see, e.g., U.S. Pat. No. 5,382,510 issued 7 Sep. 1999, and U.S. Pat. No. 5,952,170 issued 17 Jan. 1995).

Additionally, one can examine the methylation status of a FIG. 2 gene in a biological sample. Aberrant demethylation and/or hypermethylation of CpG islands in gene 5' regulatory regions frequently occurs in immortalized and transformed cells, and can result in altered expression of various genes. For example, promoter hypermethylation of the pi-class glutathione S-transferase (a protein expressed in normal prostate but not expressed in >90% of prostate carcinomas) appears to permanently silence transcription of this gene and is the most frequently detected genomic alteration in prostate carcinomas (De Marzo et al., Am. J. Pathol. 155(6): 1985-1992 (1999)). In addition, this alteration is present in at least 70% of cases of high-grade prostatic intraepithelial neoplasia (PIN) (Brooks et al., Cancer Epidemiol. Biomarkers Prev., 1998, 7:531-536). In another example, expression of the LAGE-I tumor specific gene (which is not expressed in normal prostate but is expressed in 25-50% of prostate cancers) is induced by deoxy-azacytidine in lymphoblastoid cells, suggesting that tumoral expression is due to demethylation (Lethe et al., Int. J. Cancer 76(6): 903-908 (1998)). A variety of assays for examining methylation status of a gene are well known in the art. For example, one can utilize, in Southern hybridization approaches, methylation-sensitive restriction enzymes that cannot cleave sequences that contain methylated CpG sites to assess the methylation status of CpG islands. In addition, MSP (methylation specific PCR) can rapidly profile the methylation status of all the CpG sites present in a CpG island of a given gene. This procedure involves initial modification of DNA by sodium bisulfite (which will convert all unmethylated cytosines to uracil) followed by amplification using primers specific for methylated versus unmethylated DNA. Protocols involving methylation interference can also be found for example in Current Protocols In Molecular Biology, Unit 12, Frederick M. Ausubel et al eds., 1995.

Gene amplification is an additional method for assessing the status of a FIG. 2 gene. Gene amplification is measured in a sample directly, for example, by conventional Southern blotting or Northern blotting to quantitate the transcription of mRNA (Thomas, 1980, Proc. Natl. Acad. Sci. USA, 77:5201-5205), dot blotting (DNA analysis), or in situ hybridization, using an appropriately labeled probe, based on the sequences provided herein. Alternatively, antibodies are employed that recognize specific duplexes, including DNA duplexes, RNA duplexes, and DNA-RNA hybrid duplexes or DNA-protein duplexes. The antibodies in turn are labeled and the assay carried out where the duplex is bound to a surface, so that upon the formation of duplex on the surface, the presence of antibody bound to the duplex can be detected.

Biopsied tissue or peripheral blood can be conveniently assayed for the presence of cancer cells using for example, Northern, dot blot or RT-PCR analysis to detect expression of a gene of FIG. 2. The presence of RT-PCR amplifiable FIG. 2 mRNA provides an indication of the presence of cancer. RT-PCR assays are well known in the art. RT-PCR detection assays for tumor cells in peripheral blood are currently being evaluated for use in the diagnosis and management of a number of human solid tumors. In the prostate cancer field, these include RT-PCR assays for the detection of cells expressing PSA and PSM (Verkaik et al., 1997, Urol. Res. 25:373-384; Ghossein et al., 1995, J. Clin. Oncol. 13:1195-2000; Heston et al., 1995, Clin. Chem. 41:1687-1688).

A further aspect of the invention is an assessment of the susceptibility that an individual has for developing cancer. In one embodiment, a method for predicting susceptibility to cancer comprises detecting FIG. 2 mRNA or a protein of the invention in a tissue sample, its presence indicating susceptibility to cancer, wherein the degree of FIG. 2 mRNA expression correlates to the degree of susceptibility. In a specific embodiment, the presence of a protein of the invention in, e.g., prostate tissue is examined, with the presence of a protein of FIG. 2 in the sample providing an indication of prostate cancer susceptibility (or the emergence or existence of a prostate tumor). Similarly, one can evaluate the integrity a gene in FIG. 2 nucleotide and amino acid sequences in a biological sample, in order to identify perturbations in the structure of these molecules such as insertions, deletions, substitutions and the like. The presence of one or more perturbations in genes or gene products of the invention in the sample is an indication of cancer susceptibility (or the emergence or existence of a tumor).

The invention also comprises methods for gauging tumor aggressiveness. In one embodiment, a method for gauging aggressiveness of a tumor comprises determining the level of FIG. 2 mRNA or a FIG. 2 protein expressed by tumor cells, comparing the level so determined to the level of FIG. 2 mRNA or a FIG. 2 protein expressed in a corresponding normal tissue taken from the same individual or a normal tissue reference sample, wherein the degree of FIG. 2 mRNA or a FIG. 2 protein expression in the tumor sample relative to the normal sample indicates the degree of aggressiveness. In a specific embodiment, aggressiveness of a tumor is evaluated by determining the extent to which a gene of FIG. 2 is expressed in the tumor cells, with higher expression levels indicating more aggressive tumors. Another embodiment is the evaluation of the integrity of FIG. 2 nucleotide and/or amino acid sequences in a biological sample, in order to identify perturbations in the structure of these molecules such as insertions, deletions, substitutions and the like. The presence of one or more perturbations indicates more aggressive tumors.

Another embodiment of the invention is directed to methods for observing the progression of a malignancy in an individual over time. In one embodiment, methods for observing the progression of a malignancy in an individual over time comprise determining the level of FIG. 2 mRNA or a FIG. 2 protein expressed by cells in a sample of the tumor, comparing the level so determined to the level of FIG. 2 mRNA or a FIG. 2 protein expressed in an equivalent tissue sample taken from the same individual at a different time, wherein the degree of FIG. 2 mRNA or a FIG. 2 protein expression in the tumor sample over time provides information on the progression of the cancer. In a specific embodiment, the progression of a cancer is evaluated by determining FIG. 2 gene or protein expression in the tumor cells over time, where increased expression over time indicates a progression of the cancer. Also, one can evaluate the integrity of FIG. 2 nucleotide and amino acid sequences in a biological sample in order to identify perturbations in the structure of these molecules such as insertions, deletions, substitutions and the like, where the presence of one or more perturbations indicates a progression of the cancer.

The above diagnostic approaches can be combined with any one of a wide variety of prognostic and diagnostic protocols known in the art. For example, another embodiment of the invention is directed to methods for observing a coincidence between the expression of a FIG. 2 gene and/or FIG. 2 gene products (or perturbations in a FIG. 2 gene and/or FIG. 2 gene products) and a factor that is associated with malignancy, as a means for diagnosing and prognosticating the status of a tissue sample. A wide variety of factors associated with malignancy can be utilized, such as the expression of genes associated with malignancy (e.g. PSA, PSCA and PSM expression for prostate cancer, etc.) as well as gross cytological observations (see, e.g., Bocking et al., 1984, Anal. Quant. Cytol. 6(2):74-88; Epstein, 1995, Hum. Pathol. 26(2):223-9; Thorson et al., 1998, Mod. Pathol. 11(6):543-51; Baisden et al., 1999, Am. J. Surg. Pathol. 23(8):918-24). Methods for observing a coincidence between the expression of a FIG. 2 gene and/or FIG. 2 gene products (or perturbations in a FIG. 2 gene and/or FIG. 2 gene products) and another factor that is associated with malignancy are useful, for example, because the presence of a set of specific factors that coincide with disease provides information crucial for diagnosing and prognosticating the status of a tissue sample.

In one embodiment, methods for observing a coincidence between the expression of a FIG. 2 gene and FIG. 2 gene products (or perturbations in a FIG. 2 gene and/or FIG. 2 gene products) and another factor associated with malignancy entails detecting the overexpression of FIG. 2 mRNA and/or protein in a tissue sample; detecting the overexpression of PSA mRNA or protein in a tissue sample (or PSCA or PSM expression, etc.), and observing a coincidence of FIG. 2 mRNA and/or protein and PSA mRNA or protein overexpression (or PSCA or PSM expression). In a specific embodiment, the expression of a gene of FIG. 2 and PSA mRNA in prostate tissue is examined, where the coincidence of a FIG. 2 gene and PSA mRNA overexpression in the sample indicates the existence of prostate cancer, prostate cancer susceptibility or the emergence or status of a prostate tumor.

Methods for detecting and quantifying the expression of FIG. 2 mRNA or protein are described herein, and standard nucleic acid and protein detection and quantification technologies are well known in the art. Standard methods for the detection and quantification of FIG. 2 mRNA include in situ hybridization using labeled FIG. 2 gene riboprobes, Northern blot and related techniques using FIG. 2 polynucleotide probes, RT-PCR analysis using primers specific for FIG. 2 genes, and other amplification type detection methods, such as, for example, branched DNA, SISBA, TMA and the like. In a specific embodiment, semi-quantitative RT-PCR is used to detect and quantify FIG. 2 mRNA expression. Any number of primers capable of amplifying a FIG. 2 gene can be used for this purpose, including but not limited to the various primer sets specifically described herein. In a specific embodiment, polyclonal or monoclonal antibodies specifically reactive with a wild-type FIG. 2 protein can be used in an immunohistochemical assay of biopsied tissue.

IX.) Identification of Molecules that Interact with Proteins of FIG. 2

The FIG. 2 protein and nucleic acid sequences disclosed herein allow a skilled artisan to identify proteins, small molecules and other agents that interact with the genes or proteins in FIG. 2, as well as pathways activated by genes or proteins in FIG. 2 via any one of a variety of art accepted protocols. For example, one can utilize one of the so-called interaction trap systems (also referred to as the "two-hybrid assay"). In such systems, molecules interact and reconstitute a transcription factor which directs expression of a reporter gene, whereupon the expression of the reporter gene is assayed. Other systems identify protein-protein interactions in vivo through reconstitution of a eukaryotic transcriptional activator, see, e.g., U.S. Pat. No. 5,955,280 issued 21 Sep. 1999, U.S. Pat. No. 5,925,523 issued 20 Jul. 1999, U.S. Pat. No. 5,846,722 issued 8 Dec. 1998 and U.S. Pat. No. 6,004,746 issued 21 Dec. 1999. Algorithms are also available in the art for genome-based predictions of protein function (see, e.g., Marcotte, et al., Nature 402: 4 Nov. 1999, 83-86).

Alternatively one can screen peptide libraries to identify molecules that interact with a protein sequence of the invention, e.g., a protein of FIG. 2. In such methods, peptides that bind to FIG. 2 proteins are identified by screening libraries that encode a random or controlled collection of amino acids. Peptides encoded by the libraries are expressed as fusion proteins of bacteriophage coat proteins, the bacteriophage particles are then screened against a FIG. 2 protein(s).

Accordingly, peptides having a wide variety of uses, such as therapeutic, prognostic or diagnostic reagents, are thus identified without any prior information on the structure of the expected ligand or receptor molecule. Typical peptide libraries and screening methods that can be used to identify molecules that interact with FIG. 2 protein sequences are disclosed for example in U.S. Pat. No. 5,723,286 issued 3 Mar. 1998 and U.S. Pat. No. 5,733,731 issued 31 Mar. 1998.

Alternatively, cell lines that express a protein of FIG. 2 are used to identify protein-protein interactions mediated by the respective proteins of FIG. 2. Such interactions can be examined using immunoprecipitation techniques (see, e.g., Hamilton B. J., et al. Biochem. Biophys. Res. Commun. 1999, 261:646-51). FIG. 2 proteins can be immunoprecipitated from the respective proteins of FIG. 2-*expressing* cell line using antibodies of the invention that specifically bind that protein. Alternatively, antibodies against His-tag can be used in a cell line engineered to express fusions of a protein of FIG. 2 and a His-tag (vectors mentioned above). The immunoprecipitated complex can be examined for protein association by procedures such as Western blotting, $^{35}$S-methionine labeling of proteins, protein microsequencing, silver staining and two-dimensional gel electrophoresis.

Small molecules and ligands that interact with the genes and proteins in FIG. 2 can be identified through related embodiments of such screening assays. For example, small molecules can be identified that interfere with protein function, including molecules that interfere with protein of the invention's ability to mediate phosphorylation and de-phosphorylation, interaction with DNA or RNA molecules as an indication of regulation of cell cycles, second messenger signaling or tumorigenesis. Similarly, small molecules that modulate a proteins of FIG. 2-*related* ion channel, protein pump, or cell communication functions are identified and used to treat patients that have a cancer that expresses a FIG. 2 gene (see, e.g., Hille, B., Ionic Channels of Excitable Membranes $2^{nd}$ Ed., Sinauer Assoc., Sunderland, Mass., 1992). Moreover, ligands that regulate the function of a protein of the invention can be identified based on their ability to bind proteins of the invention and activate a reporter construct. Typical methods are discussed for example in U.S. Pat. No. 5,928,868 issued 27 Jul. 1999, and include methods for forming hybrid ligands in which at least one ligand is a small molecule. In an illustrative embodiment, cells engineered to express a fusion protein of a FIG. 2 protein and a DNA-binding protein are used to co-express a fusion protein of a hybrid ligand/small molecule and a cDNA library transcriptional activator protein. The cells further contain a reporter gene, the expression of which is conditioned on the proximity of the first and second fusion proteins to each other, an event that occurs only if the hybrid ligand binds to target sites on both hybrid proteins. Those cells that express the reporter gene are selected and the unknown small molecule or the unknown ligand is identified. This method provides a means of identifying modulators which activate or inhibit a protein of the invention.

An embodiment of the invention comprises a method of screening for a molecule that interacts with a protein of the invention, e.g., an amino acid sequence shown in FIG. 2 or FIG. 3, comprising the steps of contacting a population of molecules with a FIG. 2 amino acid sequence, allowing the population of molecules and the FIG. 2 amino acid sequence to interact under conditions that facilitate an interaction, determining the presence of a molecule that interacts with the FIG. 2 amino acid sequence, and then separating molecules that do not interact with the FIG. 2 amino acid sequence from molecules that do. In a specific embodiment, the method further comprises purifying, characterizing and identifying a molecule that interacts with the FIG. 2 amino acid sequence. The identified molecule can be used to modulate a function performed by a protein of the invention. In a preferred embodiment, the protein in FIG. 2 amino acid sequence is contacted with a library of peptides.

X.) Therapeutic Methods and Compositions

The identification of a FIG. 2 as a protein that is normally expressed in a restricted set of tissues, but which is also expressed in certain cancers, opens a number of therapeutic approaches to the treatment of such cancers. As contemplated herein, the genes and proteins in FIG. 2 function as a transcription factor involved in activating tumor-promoting genes or repressing genes that block tumorigenesis.

Accordingly, therapeutic approaches that inhibit the activity of a FIG. 2 protein are useful for patients suffering from a cancer that expresses a gene of FIG. 2. These therapeutic approaches generally fall into two classes. One class comprises various methods for inhibiting the binding or association of a FIG. 2 protein with its binding partner or with other proteins. Another class comprises a variety of methods for inhibiting the transcription of a FIG. 2 gene or translation of FIG. 2 mRNA.

X.A.) Anti-Cancer Vaccines

The invention provides cancer vaccines comprising a FIG. 2-*related* protein or a FIG. 2-*related* nucleic acid. In view of the expression of a FIG. 2 protein, cancer vaccines prevent and/or treat genes of FIG. 2-*expressing* cancers with minimal or no effects on non-target tissues. The use of a tumor antigen in a vaccine that generates humoral and/or cell-mediated immune responses as anti-cancer therapy is well known in the art and has been employed in prostate cancer using human PSMA and rodent PAP immunogens (Hodge et al., 1995, Int. J. Cancer 63:231-237; Fong et al., 1997, J. Immunol. 159: 3113-3117).

Such methods can be readily practiced by employing a FIG. 2-*related* protein, or a nucleic acid sequence that encodes a FIG. 2-*related* protein and recombinant vectors capable of expressing and presenting immunogen of the invention (which typically comprises a number of antibody or T cell epitopes). Skilled artisans understand that a wide variety of vaccine systems for delivery of immunoreactive epitopes are known in the art (see, e.g., Heryln et al., Ann Med 1999 February 31(1):66-78; Maruyama et al., Cancer Immunol Immunother 2000 June 49(3):123-32) Briefly, such methods of generating an immune response (e.g. humoral and/or cell-mediated) in a mammal, comprise the steps of: exposing the mammal's immune system to an immunoreactive epitope (e.g. an epitope present in a protein of the invention, e.g., shown in FIG. 3 or analog or homolog thereof) so that the mammal generates an immune response that is specific for that epitope (e.g. generates antibodies that specifically recognize that epitope). In a preferred method, an immunogen contains a biological motif, see e.g., Tables V-XVIII, Tables XXIII to XXVI; or a peptide of a size range from a protein in FIG. 2 indicated in FIG. 5, FIG. 6, FIG. 7, FIG. 8, and/or FIG. 9.

The entire FIG. 2 protein, immunogenic regions or epitopes thereof can be combined and delivered by various means. Such vaccine compositions can include, for example, lipopeptides (e.g., Vitiello, A. et al., *J. Clin. Invest.* 95:341, 1995), peptide compositions encapsulated in poly(DL-lactide-co-glycolide) ("PLG") microspheres (see, e.g., Eldridge, et al., *Molec. Immunol.* 28:287-294, 1991: Alonso et al., *Vaccine* 12:299-306, 1994; Jones et al., *Vaccine* 13:675-681, 1995), peptide compositions contained in immune stimulating complexes (ISCOMS) (see, e.g., Takahashi et al., *Nature* 344:873-875, 1990; Hu et al., *Clin Exp Immunol.* 113:235-243, 1998), multiple antigen peptide systems (MAPs) (see e.g., Tam, J. P., *Proc. Natl. Acad. Sci. U.S.A.* 85:5409-5413, 1988; Tam, J. P., *J. Immunol. Methods* 196:17-32, 1996), peptides formulated as multivalent peptides; peptides for use in ballistic delivery systems, typically crystallized peptides, viral delivery vectors (Perkus, M. E. et al., In: *Concepts in vaccine development, Kaufmann*, S. H. E., ed., p. 379, 1996; Chakrabarti, S. et al., *Nature* 320:535, 1986; Hu, S. L. et al., *Nature* 320:537, 1986; Kieny, M.-P. et al., *AIDS Bio/Technology* 4:790, 1986; Top, F. H. et al., *J. Infect. Dis.* 124:148, 1971; Chanda, P. K. et al., *Virology* 175:535, 1990), particles of viral or synthetic origin (e.g., Kofler, N. et al., *J. Immunol. Methods.* 192:25, 1996; Eldridge, J. H. et al., *Sem. Hematol.* 30:16, 1993; Falo, L. D., Jr. et al., *Nature Med* 7:649, 1995), adjuvants (Warren, H. S., Vogel, F. R., and Chedid, L. A. *Annu. Rev. Immunol.* 4:369, 1986; Gupta, R. K. et al., *Vaccine* 11:293, 1993), liposomes (Reddy, R. et al., *J. Immunol.* 148: 1585, 1992; Rock, K. L., *Immunol Today* 17:131, 1996), or, naked or particle absorbed cDNA (Ulmer, J. B. et al., *Science* 259:1745, 1993; Robinson, H. L., Hunt, L. A., and Webster, R. G., *Vaccine* 11:957, 1993; Shiver, J. W. et al., In: *Concepts in vaccine development, Kaufmann, S. H. E., ed., p.* 423, 1996; Cease, K. B., and Berzofsky, J. A., *Annu. Rev. Immunol.* 12:923, 1994 and Eldridge, J. H. et al., *Sem. Hematol.* 30:16, 1993). Toxin-targeted delivery technologies, also known as receptor mediated targeting, such as those of Avant Immunotherapeutics, Inc. (Needham, Mass.) may also be used.

In patients with a protein of FIG. 2-*associated* cancer, the vaccine compositions of the invention can also be used in conjunction with other treatments used for cancer, e.g., surgery, chemotherapy, drug therapies, radiation therapies, etc. including use in combination with immune adjuvants such as IL-2, IL-12, GM-CSF, and the like.

Cellular Vaccines:

CTL epitopes can be determined using specific algorithms to identify peptides within a FIG. 2 protein that bind corresponding HLA alleles. In a preferred embodiment, an of the invention contains one or more amino acid sequences identified using techniques well known in the art, such as the sequences shown in Tables V-XVIII or a peptide of 8, 9, 10 or 11 amino acids specified by an HLA Class I motif/supermotif (e.g., Table IV (A), Table IV (D), or Table IV (E)) and/or a peptide of at least 9 amino acids that comprises an HLA Class II motif/supermotif (e.g., Table IV (B) or Table IV (C)). As is appreciated in the art, the HLA Class I binding groove is essentially closed ended so that peptides of only a particular size range can fit into the groove and be bound, generally HLA Class I epitopes are 8, 9, 10, or 11 amino acids long. In contrast, the HLA Class II binding groove is essentially open ended; therefore a peptide of about 9 or more amino acids can be bound by an HLA Class II molecule, as a convention 15-mer peptides that bind to HLA class II alleles are generally presented (see, e.g., Tables XXIII to XXVI). Due to the binding groove differences between HLA Class I and II, HLA Class I motifs are length specific, i.e., position two of a Class I motif is the second amino acid in an amino to carboxyl direction of the peptide. The amino acid positions in a Class II motif are relative only to each other, not the overall peptide, i.e., additional amino acids can be attached to the amino and/or carboxyl termini of a motif-bearing sequence. HLA Class II epitopes are often 9, 10, 11, 12, 13, 14, 15, 16, 17, 18, 19, 20, 21, 22, 23, 24, or 25 amino acids long, or longer than 25 amino acids.

Antibody-Based Vaccines

A wide variety of methods for generating an immune response in a mammal are known in the art (for example as the first step in the generation of hybridomas). Methods of generating an immune response in a mammal comprise exposing the mammal's immune system to an immunogenic epitope on a protein (e.g. a FIG. 2 protein) so that an immune response is generated. A typical embodiment consists of a method for generating an immune response to a protein in FIG. 2 in a host, by contacting the host with a sufficient amount of at least one protein in FIG. 2 B cell or cytotoxic T-cell epitope or analog thereof; and at least one periodic interval thereafter re-contacting the host with the B cell or cytotoxic T-cell epitope or analog thereof. A specific embodiment consists of a method of generating an immune response against a FIG. 2-*related* protein or a man-made multiepitopic peptide comprising: administering an immunogen of the invention (e.g. a FIG. 2 protein or a peptide fragment thereof, an FIG. 2 fusion protein or analog etc.) in a vaccine preparation to a human or another mammal. Typically, such vaccine preparations further contain a suitable adjuvant (see, e.g., U.S. Pat. No. 6,146,635) or a universal helper epitope such as a PADRE™ peptide (Epimmune Inc., San Diego, Calif.; see, e.g., Alexander et al., J. Immunol. 2000 164(3); 164(3): 1625-1633; Alexander et al., Immunity 1994 1(9): 751-761 and Alexander et al., Immunol. Res. 1998 18(2): 79-92). An alternative method comprises generating an immune response in an individual against an immunogen of the invention by: administering in vivo to muscle or skin of the individual's body a DNA molecule that comprises a DNA sequence that encodes an immunogen of the invention, the DNA sequence operatively linked to regulatory sequences which control the expression of the DNA sequence; wherein the DNA molecule is taken up by cells, the DNA sequence is expressed in the cells and an immune response is generated against the immunogen (see, e.g., U.S. Pat. No. 5,962,428). Optionally a genetic vaccine facilitator such as anionic lipids; saponins; lectins; estrogenic compounds; hydroxylated lower alkyls; dimethyl sulfoxide; and urea is also administered. In addition, an antiidiotypic antibody can be administered that mimics a protein set forth in FIG. 2, in order to generate a response to the target antigen.

Nucleic Acid Vaccines:

Vaccine compositions of the invention include nucleic acid-mediated modalities. DNA or RNA that encode protein (s) of the invention can be administered to a patient. Genetic immunization methods can be employed to generate prophylactic or therapeutic humoral and cellular immune responses directed against cancer cells expressing FIG. 2 proteins. Constructs comprising DNA encoding a FIG. 2-*related* protein/immunogen and appropriate regulatory sequences can be injected directly into muscle or skin of an individual, such that the cells of the muscle or skin take-up the construct and express the encoded FIG. 2 protein/immunogen. Alternatively, a vaccine comprises a FIG. 2-*related* protein. Expression of the FIG. 2-*related* protein immunogen results in the generation of prophylactic or therapeutic humoral and cellular immunity against cells that bear the FIG. 2-*related* protein. Various prophylactic and therapeutic genetic immunization techniques known in the art can be used. Nucleic acid-based delivery is described, for instance, in Wolff et. al., *Science* 247:1465 (1990) as well as U.S. Pat. Nos. 5,580,859; 5,589,466; 5,804,566; 5,739,118; 5,736,524; 5,679,647; WO 98/04720. Examples of DNA-based delivery technologies include “naked DNA”, facilitated (bupivicaine, polymers, peptide-mediated) delivery, cationic lipid complexes, and particle-mediated (“gene gun”) or pressure-mediated delivery (see, e.g., U.S. Pat. No. 5,922,687).

For therapeutic or prophylactic immunization purposes, proteins of the invention can be expressed via viral or bacterial vectors. Various viral gene delivery systems that can be used in the practice of the invention include, but are not limited to, vaccinia, fowlpox, canarypox, adenovirus, influenza, poliovirus, adeno-associated virus, lentivirus, and sindbis virus (see, e.g., Restifo, 1996, Curr. Opin. Immunol. 8:658-663; Tsang et al. *J. Natl. Cancer Inst.* 87:982-990 (1995)). Non-viral delivery systems can also be employed by introducing naked DNA encoding a FIG. 2-*related* protein into the patient (e.g., intramuscularly or intradermally) to induce an anti-tumor response.

Vaccinia virus is used, for example, as a vector to express nucleotide sequences that encode the peptides of the invention. Upon introduction into a host, the recombinant vaccinia virus expresses the protein immunogenic peptide, and thereby elicits a host immune response. Vaccinia vectors and methods useful in immunization protocols are described in, e.g., U.S. Pat. No. 4,722,848. Another vector is BCG (Bacille Calmette Guerin). BCG vectors are described in Stover et al., *Nature* 351:456-460 (1991). A wide variety of other vectors useful for therapeutic administration or immunization of the peptides of the invention, e.g. adeno and adeno-associated virus vectors, retroviral vectors, *Salmonella typhi* vectors, detoxified anthrax toxin vectors, and the like, will be apparent to those skilled in the art from the description herein.

Thus, gene delivery systems are used to deliver a FIG. 2-*related* nucleic acid molecule. In one embodiment, the full-length human gene of FIG. 2 cDNA is employed. In another embodiment, FIG. 2 nucleic acid molecules encoding specific cytotoxic T lymphocyte (CTL) and/or antibody epitopes are employed.

Ex Vivo Vaccines

Various ex vivo strategies can also be employed to generate an immune response. One approach involves the use of antigen presenting cells (APCs) such as dendritic cells (DC) to present antigen of the invention to a patient's immune system. Dendritic cells express MHC class I and II molecules, B7 co-stimulator, and IL-12, and are thus highly specialized antigen presenting cells. In prostate cancer, autologous dendritic cells pulsed with peptides of the prostate-specific membrane antigen (PSMA) are being used in a Phase I clinical trial to stimulate prostate cancer patients' immune systems (Tjoa et al., 1996, Prostate 28:65-69; Murphy et al., 1996, Prostate 29:371-380). Thus, dendritic cells can be used to present peptide immunogens of the invention to T cells in the context of MHC class I or II molecules. In one embodiment, autologous dendritic cells are pulsed with immunogenic peptides capable of binding to MHC class I and/or class II molecules. In another embodiment, dendritic cells are pulsed with the complete FIG. 2 protein. Yet another embodiment involves engineering the overexpression of a FIG. 2 gene in dendritic cells using various implementing vectors known in the art, such as adenovirus (Arthur et al., 1997, Cancer Gene Ther. 4:17-25), retrovirus (Henderson et al., 1996, Cancer Res. 56:3763-3770), lentivirus, adeno-associated virus, DNA transfection (Ribas et al., 1997, Cancer Res. 57:2865-2869), or tumor-derived RNA transfection (Ashley et al., 1997, J. Exp. Med. 186:1177-1182). Cells that express proteins of the invention can also be engineered to express immune modulators, such as GM-CSF, and used as immunizing agents.

X.B.) A Protein of FIG. 2 as a Target for Antibody-Based Therapy

Proteins of the invention, e.g. FIG. 2, are attractive targets for antibody-based therapeutic strategies. A number of antibody strategies are known in the art for targeting both extracellular and intracellular molecules (see, e.g., complement and ADCC mediated killing as well as the use of intrabodies). Because of the expression profiles of the proteins set forth in FIG. 2, e.g., expressed by cancer cells of various lineages at higher levels compared to corresponding normal cells, systemic administration of proteins in FIG. 2-*immunoreactive* compositions are prepared that exhibit excellent sensitivity without toxic, non-specific and/or non-target effects caused by binding of the immunoreactive composition to non-target organs and tissues. Antibodies specifically reactive with domains of FIG. 2 proteins are useful to systemically treat cancers that express a protein of FIG. 2, either as conjugates with a toxin or therapeutic agent, or as naked antibodies capable of inhibiting cell proliferation or function.

Antibodies of the invention can be introduced into a patient such that the antibody binds to a protein of the invention and modulate a function, such as an interaction with a binding partner, and consequently mediates destruction of the tumor cells and/or inhibits the growth of the tumor cells. Mechanisms by which such antibodies exert a therapeutic effect can include complement-mediated cytolysis, antibody-dependent cellular cytotoxicity, modulation of the physiological function of proteins of the invention, inhibition of ligand binding or signal transduction pathways, modulation of tumor cell differentiation, alteration of tumor angiogenesis factor profiles, and/or apoptosis.

Those skilled in the art understand that antibodies can be used to specifically target and bind immunogenic molecules such as an immunogenic region of a protein of the invention such as a protein sequence shown in FIG. 2 or FIG. 3. In addition, skilled artisans understand that it is routine to conjugate antibodies to cytotoxic agents (see, e.g., Slevers et al. *Blood* 93:11 3678-3684 (Jun. 1, 1999)). When cytotoxic and/or therapeutic agents are delivered directly to cells, such as by conjugating them to antibodies specific for a molecule expressed by that cell (e.g. a protein of FIG. 2), the cytotoxic agent will exert its known biological effect (i.e. cytotoxicity) on those cells.

A wide variety of compositions and methods for using antibody-cytotoxic agent conjugates to kill cells are known in the art. In the context of cancers, typical methods entail administering to an animal having a tumor a biologically effective amount of a conjugate comprising a selected cytotoxic and/or therapeutic agent linked to a targeting agent (e.g. an antibody that specifically binds a protein of FIG. 2) that binds to a marker (e.g. a protein of FIG. 2) expressed, accessible to binding or localized on the cell surfaces. A typical embodiment is a method of delivering a cytotoxic and/or therapeutic agent to a cell expressing a FIG. 2 protein, comprising conjugating the cytotoxic agent to an antibody that immunospecifically binds to a protein in FIG. 2 epitope, and, exposing the cell to the antibody-agent conjugate. Another illustrative embodiment is a method of treating an individual suspected of suffering from metastasized cancer, comprising a step of administering parenterally to said individual a pharmaceutical composition comprising a therapeutically effective amount of an antibody conjugated to a cytotoxic and/or therapeutic agent.

Cancer immunotherapy using antibodies o the invention can be done in accordance with various approaches that have been successfully employed in the treatment of other types of cancer, including but not limited to colon cancer (Arlen et al., 1998, Crit. Rev. Immunol. 18:133-138), multiple myeloma (Ozaki et al., 1997, Blood 90:3179-3186, Tsunenari et al., 1997, Blood 90:2437-2444), gastric cancer (Kasprzyk et al., 1992, Cancer Res. 52:2771-2776), B-cell lymphoma (Funakoshi et al., 1996, J. Immunother. Emphasis Tumor Immunol. 19:93-101), leukemia (Zhong et al., 1996, Leuk. Res. 20:581-589), colorectal cancer (Moun et al., 1994, Cancer Res. 54:6160-6166; Velders et al., 1995, Cancer Res. 55:4398-4403), and breast cancer (Shepard et al., 1991, J. Clin. Immunol. 11:117-127). Some therapeutic approaches involve conjugation of naked antibody to a toxin or radioisotope, such as the conjugation of $Y^{91}$ or $I^{131}$ to anti-CD20 antibodies (e.g., Zevalin™, IDEC Pharmaceuticals Corp. or Bexxar™, Coulter Pharmaceuticals), while others involve co-administration of antibodies and other therapeutic agents, such as Herceptin™ (trastuzumab) with paclitaxel (Genentech, Inc.). The antibodies can be conjugated to a therapeutic agent. To treat prostate cancer, for example, antibodies of the invention can be administered in conjunction with radiation, chemotherapy or hormone ablation. Also, antibodies can be conjugated to a toxin such as calicheamicin (e.g., Mylotarg™, Wyeth-Ayerst, Madison, N.J., a recombinant humanized $IgG_4$ kappa antibody conjugated to antitumor antibiotic calicheamicin) or a maytansinoid (e.g., taxane-based Tumor-Activated Prodrug, TAP, platform, ImmunoGen, Cambridge, Mass., also see e.g., U.S. Pat. No. 5,416,064).

Although antibody therapy directed to a protein of the invention is useful for all stages of cancer, antibody therapy can be particularly appropriate in advanced or metastatic cancers. Treatment with the antibody therapy of the invention is indicated for patients who have received one or more rounds of chemotherapy. Alternatively, antibody therapy of the invention is combined with a chemotherapeutic or radiation regimen for patients who have not received chemotherapeutic treatment. Additionally, antibody therapy can enable the use of reduced dosages of concomitant chemotherapy, particularly for patients who do not tolerate the toxicity of the chemotherapeutic agent very well. Fan et al. (Cancer Res. 53:4637-4642, 1993), Prewett et al. (International J. of Onco. 9:217-224, 1996), and Hancock et al. (Cancer Res. 51:4575-4580, 1991) describe the use of various antibodies together with chemotherapeutic agents. Treatment with the antibody therapy of the invention is indicated for patients who have received one or more rounds of chemotherapy. Alternatively, antibody therapy of the invention is combined with a chemotherapeutic or radiation regimen for patients who have not received chemotherapeutic treatment. Additionally, antibody therapy can enable the use of reduced dosages of concomitant chemotherapy, particularly for patients who do not tolerate the toxicity of the chemotherapeutic agent very well.

Cancer patients can be evaluated for the presence and level of expression of a gene of FIG. 2, preferably using immunohistochemical assessments of tumor tissue, quantitative imaging of a protein of the invention, or other techniques that reliably indicate the presence and degree of a FIG. 2 protein expression. Immunohistochemical analysis of tumor biopsies or surgical specimens is preferred for this purpose. Methods for immunohistochemical analysis of tumor tissues are well known in the art.

Monoclonal antibodies of the invention that treat cancers (e.g., of a tissue of Table I) include those that initiate a potent immune response against the tumor or those that are directly cytotoxic. In this regard, monoclonal antibodies (mAbs) of the invention can elicit tumor cell lysis by either complement-mediated or antibody-dependent cell cytotoxicity (ADCC) mechanisms, both of which require an intact Fc portion of the immunoglobulin molecule for interaction with effector cell Fc receptor sites on complement proteins. In addition, mAbs of the invention that exert a direct biological effect on tumor growth are useful to treat cancers that express proteins in FIG. 2. Mechanisms by which directly cytotoxic mAbs act include: inhibition of cell growth, modulation of cellular differentiation, modulation of tumor angiogenesis factor profiles, and the induction of apoptosis. The mechanism(s) by which a particular mAbs of the invention exert an anti-tumor effect is evaluated using any number of in vitro assays that evaluate cell death such as ADCC, ADMMC, complement-mediated cell lysis, and so forth, as is generally known in the art.

In some patients, the use of murine or other non-human monoclonal antibodies, or human/mouse chimeric mAbs can induce moderate to strong immune responses against the non-human antibody. This can result in clearance of the antibody from circulation and reduced efficacy. In the most severe cases, such an immune response can lead to the extensive formation of immune complexes which, potentially, can cause renal failure. Accordingly, preferred monoclonal antibodies used in the therapeutic methods of the invention are those that are either fully human or humanized and that bind specifically to the target of proteins in FIG. 2 antigens with high affinity but exhibit low or no antigenicity in the patient.

Therapeutic methods of the invention contemplate the administration of single mAbs as well as combinations, or cocktails, of different mAbs. Such mAb cocktails can have certain advantages inasmuch as they contain mAbs that target different epitopes, exploit different effector mechanisms or combine directly cytotoxic mAbs with mAbs that rely on immune effector functionality. Such mAbs in combination can exhibit synergistic therapeutic effects. In addition, mAbs of the invention can be administered concomitantly with other therapeutic modalities, including but not limited to various chemotherapeutic agents, androgen-blockers, immune modulators (e.g., IL-2, GM-CSF), surgery or radiation. The mAbs of the invention are administered in their "naked" or unconjugated form, or can have a therapeutic agent(s) conjugated to them.

Antibody formulations of the invention are administered via any route capable of delivering the antibodies to a tumor cell. Routes of administration include, but are not limited to, intravenous, intraperitoneal, intramuscular, intratumor, intradermal, and the like. Treatment generally involves repeated administration of an antibody preparation of the invention, via an acceptable route of administration such as intravenous injection (IV), typically at a dose in the range of about 0.1, 0.2, 0.3, 0.4, 0.5, 0.6, 0.7, 0.8, 0.9, 1, 2, 3, 4, 5, 6, 7, 8, 9, 10, 15, 20, or 25 mg/kg body weight. In general, doses in the range of 10-1000 mg mAb per week are effective and well tolerated.

Based on clinical experience with the Herceptin™ mAb in the treatment of metastatic breast cancer, an initial loading dose of approximately 4 mg/kg patient body weight IV, followed by weekly doses of about 2 mg/kg IV of the mAb preparation represents an acceptable dosing regimen. Preferably, the initial loading dose is administered as a 90 minute or longer infusion. The periodic maintenance dose is administered as a 30 minute or longer infusion, provided the initial dose was well tolerated. As appreciated by those of skill in the art, various factors can influence the ideal dose regimen in a particular case. Such factors include, for example, the binding affinity and half life of the Ab or mAbs used, the degree of expression of the protein of the invention in the patient, the extent of circulating shed protein of the invention, the desired steady-state antibody concentration level, frequency of treatment, and the influence of chemotherapeutic or other agents used in combination with the treatment method of the invention, as well as the health status of a particular patient.

Optionally, patients should be evaluated for the levels of a protein of the invention in a given sample (e.g. the levels of circulating FIG. 2 protein antigen and/or proteins of FIG. 2-*expressing* cells) in order to assist in the determination of the most effective dosing regimen, etc. Such evaluations are also used for monitoring purposes throughout therapy, and are useful to gauge therapeutic success in combination with the evaluation of other parameters (for example, urine cytology and/or ImmunoCyt levels in bladder cancer therapy, or by analogy, serum PSA levels in prostate cancer therapy).

Anti-idiotypic antibodies of the invention can also be used in anti-cancer therapy as a vaccine for inducing an immune response to cells that express a FIG. 2-*related* protein. In particular, the generation of anti-idiotypic antibodies is well known in the art; this methodology can readily be adapted to generate anti-idiotypic anti-protein of FIG. 2 antibodies that mimic an epitope on a FIG. 2-*related* protein (see, for example, Wagner et al., 1997, Hybridoma 16: 33-40; Foon et al., 1995, J. Clin. Invest. 96:334-342; Herlyn et al., 1996, Cancer Immunol. Immunother. 43:65-76). Such an anti-idiotypic antibody can be used in cancer vaccine strategies.

X.C.) A Protein of FIG. 2 as a Target for Cellular Immune Responses

Vaccines and methods of preparing vaccines that contain an immunogenically effective amount of one or more HLA-binding peptides as described herein are further embodiments of the invention. Furthermore, vaccines in accordance with the invention encompass compositions of one or more of the claimed peptides. A peptide can be present in a vaccine individually. Alternatively, the peptide can exist as a homopolymer comprising multiple copies of the same peptide, or as a heteropolymer of various peptides. Polymers have the advantage of increased immunological reaction and, where different peptide epitopes are used to make up the polymer, the additional ability to induce antibodies and/or CTLs that react with different antigenic determinants of the pathogenic organism or tumor-related peptide targeted for an immune response. The composition can be a naturally occurring region of an antigen or can be prepared, e.g., recombinantly or by chemical synthesis.

Carriers that can be used with vaccines of the invention are well known in the art, and include, e.g., thyroglobulin, albumins such as human serum albumin, tetanus toxoid, polyamino acids such as poly L-lysine, poly L-glutamic acid, influenza, hepatitis B virus core protein, and the like. The vaccines can contain a physiologically tolerable (i.e., acceptable) diluent such as water, or saline, preferably phosphate buffered saline. The vaccines also typically include an adjuvant. Adjuvants such as incomplete Freund's adjuvant, aluminum phosphate, aluminum hydroxide, or alum are examples of materials well known in the art. Additionally, as disclosed herein, CTL responses can be primed by conjugating peptides of the invention to lipids, such as tripalmitoyl-S-glycerylcysteinlyseryl-serine ($P_3CSS$). Moreover, an adjuvant such as a synthetic cytosine-phosphorothiolatedguanine-containing (CpG) oligonucleotides has been found to increase CTL responses 10- to 100-fold. (see, e.g. Davila and Celis *J. Immunol.* 165:539-547 (2000))

Upon immunization with a peptide composition in accordance with the invention, via injection, aerosol, oral, transdermal, transmucosal, intrapleural, intrathecal, or other suitable routes, the immune system of the host responds to the vaccine by producing large amounts of CTLs and/or HTLs specific for the desired antigen. Consequently, the host becomes at least partially immune to later development of cells that express or overexpress an antigen of a protein of FIG. 2, or the host derives at least some therapeutic benefit when the antigen was tumor-associated.

In some embodiments, it may be desirable to combine the class I peptide components with components that induce or facilitate neutralizing antibody and or helper T cell responses directed to the target antigen. A preferred embodiment of such a composition comprises class I and class II epitopes in accordance with the invention. An alternative embodiment of such a composition comprises a class I and/or class II epitope in accordance with the invention, along with a cross reactive HTL epitope such as PADRE™ (Epimmune, San Diego, Calif.) molecule (described e.g., in U.S. Pat. No. 5,736,142).

A vaccine of the invention can also include antigen-presenting cells (APC), such as dendritic cells (DC), as a vehicle to present peptides of the invention. Vaccine compositions can be created in vitro, following dendritic cell mobilization and harvesting, whereby loading of dendritic cells occurs in vitro. For example, dendritic cells are transfected, e.g., with a minigene in accordance with the invention, or are pulsed with peptides. The dendritic cell can then be administered to a patient to elicit immune responses in vivo. Vaccine compositions, either DNA- or peptide-based, can also be administered in vivo in combination with dendritic cell mobilization whereby loading of dendritic cells occurs in vivo.

Preferably, the following principles are utilized when selecting an array of epitopes for inclusion in a polyepitopic composition for use in a vaccine, or for selecting discrete epitopes to be included in a vaccine and/or to be encoded by nucleic acids such as a minigene. It is preferred that each of the following principles be balanced in order to make the selection. The multiple epitopes to be incorporated in a given vaccine composition may be, but need not be, contiguous in sequence in the native antigen from which the epitopes are derived.

1.) Epitopes are selected which, upon administration, mimic immune responses that have been observed to be correlated with tumor clearance. For HLA Class I this includes 3-4 epitopes that come from at least one tumor associated antigen (TAA). For HLA Class II a similar rationale is employed; again 3-4 epitopes are selected from at least one TAA (see, e.g., Rosenberg et al., *Science* 278:1447-1450). Epitopes from one TAA may be used in combination with epitopes from one or more additional TAAs to produce a vaccine that targets tumors with varying expression patterns of frequently-expressed TAAs.

2.) Epitopes are selected that have the requisite binding affinity established to be correlated with immunogenicity: for HLA Class I an $IC_{50}$ of 500 nM or less, often 200 nM or less; and for Class II an $IC_{50}$ of 1000 nM or less.

3.) Sufficient supermotif bearing-peptides, or a sufficient array of allele-specific motif-bearing peptides, are selected to give broad population coverage. For example, it is preferable to have at least 80% population coverage. A Monte Carlo analysis, a statistical evaluation known in the art, can be employed to assess the breadth, or redundancy of, population coverage.

4.) When selecting epitopes from cancer-related antigens it is often useful to select analogs because the patient may have developed tolerance to the native epitope.

5.) Of particular relevance are epitopes referred to as "nested epitopes." Nested epitopes occur where at least two epitopes overlap in a given peptide sequence. A nested peptide sequence can comprise B cell, HLA class I and/or HLA class II epitopes. When providing nested epitopes, a general objective is to provide the greatest number of epitopes per sequence. Thus, an aspect is to avoid providing a peptide that is any longer than the amino terminus of the amino terminal epitope and the carboxyl terminus of the carboxyl terminal epitope in the peptide. When providing a multi-epitopic sequence, such as a sequence comprising nested epitopes, it is generally important to screen the sequence in order to insure that it does not have pathological or other deleterious biological properties.

6.) If a polyepitopic protein is created, or when creating a minigene, an objective is to generate the smallest peptide that encompasses the epitopes of interest. This principle is similar, if not the same as that employed when selecting a peptide comprising nested epitopes. However, with an artificial polyepitopic peptide, the size minimization objective is balanced against the need to integrate any spacer sequences between epitopes in the polyepitopic protein. Spacer amino acid residues can, for example, be introduced to avoid junctional epitopes (an epitope recognized by the immune system, not present in the target antigen, and only created by the man-made juxtaposition of epitopes), or to facilitate cleavage between epitopes and thereby enhance epitope presentation. Junctional epitopes are generally to be avoided because the recipient may generate an immune response to that non-native epitope. Of particular concern is a junctional epitope that is a "dominant epitope." A dominant epitope may lead to such a zealous response that immune responses to other epitopes are diminished or suppressed.

7.) Where the sequences of multiple variants of the same target protein are present, potential peptide epitopes can also be selected on the basis of their conservancy. For example, a criterion for conservancy may define that the entire sequence of an HLA class I binding peptide or the entire 9-mer core of a class II binding peptide be conserved in a designated percentage of the sequences evaluated for a specific protein antigen.

X.C.1. Minigene Vaccines

A number of different approaches are available which allow simultaneous delivery of multiple epitopes. Nucleic acids encoding the peptides of the invention are a particularly useful embodiment of the invention. Epitopes for inclusion in a minigene are preferably selected according to the guidelines set forth in the previous section. A preferred means of administering nucleic acids encoding the peptides of the invention uses minigene constructs encoding a peptide comprising one or multiple epitopes of the invention.

The use of multi-epitope minigenes is described below and in, Ishioka et al., *J. Immunol.* 162:3915-3925, 1999; An, L. and Whitton, J. L., *J. Virol.* 71:2292, 1997; Thomson, S. A. et al., *J. Immunol.* 157:822, 1996; Whitton, J. L. et al., *J. Virol.* 67:348, 1993; Hanke, R. et al., *Vaccine* 16:426, 1998. For example, a multi-epitope DNA plasmid encoding supermotif- and/or motif-bearing epitopes derived from a protein of the invention, the PADRE® universal helper T cell epitope (or multiple HTL epitopes from a protein of the invention), and an endoplasmic reticulum-translocating signal sequence can be engineered. A vaccine may also comprise epitopes that are derived from other TAAs.

The immunogenicity of a multi-epitopic minigene can be confirmed in transgenic mice to evaluate the magnitude of CTL induction responses against the epitopes tested. Further, the immunogenicity of DNA-encoded epitopes in vivo can be correlated with the in vitro responses of specific CTL lines against target cells transfected with the DNA plasmid. Thus, these experiments can show that the minigene serves: 1.) to generate a CTL response; and, 2.) that the induced CTLs recognized cells expressing the encoded epitopes.

For example, to create a DNA sequence encoding the selected epitopes (minigene) for expression in human cells, the amino acid sequences of the epitopes may be reverse translated. A human codon usage table can be used to guide the codon choice for each amino acid. These epitope-encoding DNA sequences may be directly adjoined, so that when translated, a continuous polypeptide sequence is created. To optimize expression and/or immunogenicity, additional elements can be incorporated into the minigene design. Examples of amino acid sequences that can be reverse translated and included in the minigene sequence include: HLA class I epitopes, HLA class II epitopes, antibody epitopes, a ubiquitination signal sequence, and/or an endoplasmic reticulum targeting signal. In addition, HLA presentation of CTL and HTL epitopes may be improved by including synthetic (e.g. poly-alanine) or naturally-occurring flanking sequences adjacent to the CTL or HTL epitopes; these larger peptides comprising the epitope(s) are within the scope of the invention.

The minigene sequence may be converted to DNA by assembling oligonucleotides that encode the plus and minus strands of the minigene. Overlapping oligonucleotides (30-100 bases long) may be synthesized, phosphorylated, purified and annealed under appropriate conditions using well known techniques. The ends of the oligonucleotides can be joined, for example, using T4 DNA ligase. This synthetic minigene, encoding the epitope polypeptide, can then be cloned into a desired expression vector.

Standard regulatory sequences well known to those of skill in the art are preferably included in the vector to ensure expression in the target cells. Several vector elements are desirable: a promoter with a down-stream cloning site for minigene insertion; a polyadenylation signal for efficient transcription termination; an *E. coli* origin of replication; and an *E. coli* selectable marker (e.g. ampicillin or kanamycin resistance). Numerous promoters can be used for this purpose, e.g., the human cytomegalovirus (hCMV) promoter. See, e.g., U.S. Pat. Nos. 5,580,859 and 5,589,466 for other suitable promoter sequences.

Additional vector modifications may be desired to optimize minigene expression and immunogenicity. In some cases, introns are required for efficient gene expression, and one or more synthetic or naturally-occurring introns could be incorporated into the transcribed region of the minigene. The inclusion of mRNA stabilization sequences and sequences for replication in mammalian cells may also be considered for increasing minigene expression.

Once an expression vector is selected, the minigene is cloned into the polylinker region downstream of the promoter. This plasmid is transformed into an appropriate *E. coli* strain, and DNA is prepared using standard techniques. The orientation and DNA sequence of the minigene, as well as all other elements included in the vector, are confirmed using restriction mapping and DNA sequence analysis. Bacterial cells harboring the correct plasmid can be stored as a master cell bank and a working cell bank.

In addition, immunostimulatory sequences (ISSs or CpGs) appear to play a role in the immunogenicity of DNA vaccines. These sequences may be included in the vector, outside the minigene coding sequence, if desired to enhance immunogenicity.

In some embodiments, a bi-cistronic expression vector which allows production of both the minigene-encoded epitopes and a second protein (included to enhance or decrease immunogenicity) can be used. Examples of proteins or polypeptides that could beneficially enhance the immune response if co-expressed include cytokines (e.g., IL-2, IL-12, GM-CSF), cytokine-inducing molecules (e.g., LeIF), costimulatory molecules, or for HTL responses, pan-DR binding proteins (PADRE™, Epimmune, San Diego, Calif.). Helper (HTL) epitopes can be joined to intracellular targeting signals and expressed separately from expressed CTL epitopes; this allows direction of the HTL epitopes to a cell compartment different than that of the CTL epitopes. If required, this could facilitate more efficient entry of HTL epitopes into the HLA class II pathway, thereby improving HTL induction. In contrast to HTL or CTL induction, specifically decreasing the immune response by co-expression of immunosuppressive molecules (e.g. TGF-β) may be beneficial in certain diseases.

Therapeutic quantities of plasmid DNA can be produced for example, by fermentation in *E. coli*, followed by purification. Aliquots from the working cell bank are used to inoculate growth medium, and grown to saturation in shaker flasks or a bioreactor according to well-known techniques. Plasmid DNA can be purified using standard bioseparation technologies such as solid phase anion-exchange resins supplied by QIAGEN, Inc. (Valencia, Calif.). If required, supercoiled DNA can be isolated from the open circular and linear forms using gel electrophoresis or other methods.

Purified plasmid DNA can be prepared for injection using a variety of formulations. The simplest of these is reconstitution of lyophilized DNA in sterile phosphate-buffer saline (PBS). This approach, known as "naked DNA," is currently being used for intramuscular (IM) administration in clinical trials. To maximize the immunotherapeutic effects of minigene DNA vaccines, an alternative method for formulating purified plasmid DNA may be desirable. A variety of methods have been described, and new techniques may become available. Cationic lipids, glycolipids, and fusogenic liposomes can also be used in the formulation (see, e.g., as described by WO 93/24640; Mannino & Gould-Fogerite, *BioTechniques* 6(7): 682 (1988); U.S. Pat. No. 5,279,833; WO 91/06309; and Felgner, et al., *Proc. Nat'l Acad. Sci. USA* 84:7413 (1987). In addition, peptides and compounds referred to collectively as protective, interactive, non-condensing compounds (PINC) could also be complexed to purified plasmid DNA to influence variables such as stability, intramuscular dispersion, or trafficking to specific organs or cell types.

Target cell sensitization can be used as a functional assay for expression and HLA class I presentation of minigene-encoded CTL epitopes. For example, the plasmid DNA is introduced into a mammalian cell line that is suitable as a target for standard CTL chromium release assays. The transfection method used will be dependent on the final formulation. Electroporation can be used for "naked" DNA, whereas cationic lipids allow direct in vitro transfection. A plasmid expressing green fluorescent protein (GFP) can be co-transfected to allow enrichment of transfected cells using fluorescence activated cell sorting (FACS). These cells are then chromium-51 ($^{51}Cr$) labeled and used as target cells for epitope-specific CTL lines; cytolysis, detected by $^{51}Cr$ release, indicates both production of, and HLA presentation of, minigene-encoded CTL epitopes. Expression of HTL epitopes may be evaluated in an analogous manner using assays to assess HTL activity.

In vivo immunogenicity is a second approach for functional testing of minigene DNA formulations. Transgenic mice expressing appropriate human HLA proteins are immunized with the DNA product. The dose and route of administration are formulation dependent (e.g., IM for DNA in PBS, intraperitoneal (i.p.) for lipid-complexed DNA). Twenty-one days after immunization, splenocytes are harvested and restimulated for one week in the presence of peptides encoding each epitope being tested. Thereafter, for CTL effector cells, assays are conducted for cytolysis of peptide-loaded, $^{51}Cr$-labeled target cells using standard techniques. Lysis of target cells that were sensitized by HLA loaded with peptide epitopes, corresponding to minigene-encoded epitopes, demonstrates DNA vaccine function for in vivo induction of CTLs. Immunogenicity of HTL epitopes is confirmed in transgenic mice in an analogous manner.

Alternatively, the nucleic acids can be administered using ballistic delivery as described, for instance, in U.S. Pat. No. 5,204,253. Using this technique, particles comprised solely of DNA are administered. In a further alternative embodiment, DNA can be adhered to particles, such as gold particles.

Minigenes can also be delivered using other bacterial or viral delivery systems well known in the art, e.g., an expression construct encoding epitopes of the invention can be incorporated into a viral vector such as vaccinia.

X.C.2. Combinations of CTL Peptides with Helper Peptides

Vaccine compositions comprising CTL peptides of the invention can be modified, e.g., analoged, to provide desired attributes, such as improved serum half life, broadened population coverage or enhanced immunogenicity.

For instance, the ability of a peptide to induce CTL activity can be enhanced by linking the peptide to a sequence which contains at least one epitope that is capable of inducing a T helper cell response. Although a CTL peptide can be directly linked to a T helper peptide, often CTL epitope/HTL epitope conjugates are linked by a spacer molecule. The spacer is typically comprised of relatively small, neutral molecules, such as amino acids or amino acid mimetics, which are substantially uncharged under physiological conditions. The spacers are typically selected from, e.g., Ala, Gly, or other neutral spacers of nonpolar amino acids or neutral polar amino acids. It will be understood that the optionally present spacer need not be comprised of the same residues and thus may be a hetero- or homo-oligomer. When present, the spacer will usually be at least one or two residues, more usually three to six residues and sometimes 10 or more residues. The CTL peptide epitope can be linked to the T helper peptide epitope either directly or via a spacer either at the amino or carboxy terminus of the CTL peptide. The amino terminus of either the immunogenic peptide or the T helper peptide may be acylated.

In certain embodiments, the T helper peptide is one that is recognized by T helper cells present in a majority of a genetically diverse population. This can be accomplished by selecting peptides that bind to many, most, or all of the HLA class II molecules. Examples of such amino acid bind many HLA Class II molecules include sequences from antigens such as tetanus toxoid at positions 830-843 (QYIKANSKFIGITE; SEQ ID NO: 174), *Plasmodium falciparum* circumsporozoite (CS) protein at positions 378-398 (DIEKKIAKMEKASSVFNVVNS; SEQ ID NO: 175), and *Streptococcus* 18 kD protein at positions 116-131 (GAVDSILGGVATYGAA; SEQ ID NO: 176). Other examples include peptides bearing a DR 1-4-7 supermotif, or either of the DR3 motifs.

Alternatively, it is possible to prepare synthetic peptides capable of stimulating T helper lymphocytes, in a loosely HLA-restricted fashion, using amino acid sequences not found in nature (see, e.g., PCT publication WO 95/07707). These synthetic compounds called Pan-DR-binding epitopes (e.g., PADRE™, Epimmune, Inc., San Diego, Calif.) are designed to most preferably bind most HLA-DR (human HLA class II) molecules. For instance, a pan-DR-binding epitope peptide having the formula: aKXVAAWTLKAAa (SEQ ID NO: 177), where "X" is either cyclohexylalanine, phenylalanine, or tyrosine, and a is either D-alanine or L-alanine, has been found to bind to most HLA-DR alleles, and to stimulate the response of T helper lymphocytes from most individuals, regardless of their HLA type. An alternative of a pan-DR binding epitope comprises all "L" natural amino acids and can be provided in the form of nucleic acids that encode the epitope.

HTL peptide epitopes can also be modified to alter their biological properties. For example, they can be modified to include D-amino acids to increase their resistance to proteases and thus extend their serum half life, or they can be conjugated to other molecules such as lipids, proteins, carbohydrates, and the like to increase their biological activity. For example, a T helper peptide can be conjugated to one or more palmitic acid chains at either the amino or carboxyl termini.

X.C.3. Combinations of CTL Peptides with T Cell Priming Agents

In some embodiments it may be desirable to include in the pharmaceutical compositions of the invention at least one component which primes B lymphocytes or T lymphocytes. Lipids have been identified as agents capable of priming CTL in vivo. For example, palmitic acid residues can be attached to the $\epsilon$- and $\alpha$-amino groups of a lysine residue and then linked, e.g., via one or more linking residues such as Gly, Gly-Gly-, Ser, Ser-Ser, or the like, to an immunogenic peptide. The lipidated peptide can then be administered either directly in a micelle or particle, incorporated into a liposome, or emulsified in an adjuvant, e.g. incomplete Freund's adjuvant. In a preferred embodiment, a particularly effective immunogenic composition comprises palmitic acid attached to $\epsilon$- and $\alpha$-amino groups of Lys, which is attached via linkage, e.g., Ser-Ser, to the amino terminus of the immunogenic peptide.

As another example of lipid priming of CTL responses, *E. coli* lipoproteins, such as tripalmitoyl-S-glycerylcysteinlyseryl-serine ($P_3CSS$) can be used to prime virus specific CTL when covalently attached to an appropriate peptide (see, e.g., Deres, et al., *Nature* 342:561, 1989). Peptides of the invention can be coupled to $P_3CSS$, for example, and the lipopeptide administered to an individual to specifically prime an immune response to the target antigen. Moreover, because the induction of neutralizing antibodies can also be primed with $P_3CSS$-conjugated epitopes, two such compositions can be combined to more effectively elicit both humoral and cell-mediated responses.

X.C.4. Vaccine Compositions Comprising DC Pulsed with CTL and/or HTL Peptides

An embodiment of a vaccine composition in accordance with the invention comprises ex vivo administration of a cocktail of epitope-bearing peptides to PBMC, or isolated DC therefrom, from the patient's blood. A pharmaceutical to facilitate harvesting of DC can be used, such as Progenipoietin™ (Pharmacia-Monsanto, St. Louis, Mo.) or GM-CSF/IL-4. After pulsing the DC with peptides and prior to reinfusion into patients, the DC are washed to remove unbound peptides. In this embodiment, a vaccine comprises peptide-pulsed DCs which present the pulsed peptide epitopes complexed with HLA molecules on their surfaces.

The DC can be pulsed ex vivo with a cocktail of peptides, some of which stimulate CTL responses to a protein of FIG. 2. Optionally, a helper T cell (HTL) peptide, such as a natural or artificial loosely restricted HLA Class II peptide, can be included to facilitate the CTL response. Thus, a vaccine in accordance with the invention is used to treat a cancer which expresses or overexpresses a protein of FIG. 2.

X.D. Adoptive Immunotherapy

Antigenic peptides of the invention, e.g., peptides derived from a protein of FIG. 2, are used to elicit a CTL and/or HTL response ex vivo, as well. The resulting CTL or HTL cells, can be used to treat tumors in patients that do not respond to other conventional forms of therapy, or will not respond to a therapeutic vaccine peptide or nucleic acid in accordance with the invention. Ex vivo CTL or HTL responses to a particular antigen are induced by incubating in tissue culture the patient's, or genetically compatible, CTL or HTL precursor cells together with a source of antigen-presenting cells (APC), such as dendritic cells, and the appropriate immunogenic peptide. After an appropriate incubation time (typically about 7-28 days), in which the precursor cells are activated and expanded into effector cells, the cells are infused back into the patient, where they will destroy (CTL) or facilitate destruction (HTL) of their specific target cell (e.g., a tumor cell). Transfected dendritic cells may also be used as antigen presenting cells.

X.E. Administration of Vaccines for Therapeutic or Prophylactic Purposes

Pharmaceutical and vaccine compositions of the invention are typically used to treat and/or prevent a cancer that expresses or overexpresses a FIG. 2 protein. In therapeutic applications, peptide and/or nucleic acid compositions are administered to a patient in an amount sufficient to elicit an effective B cell, CTL and/or HTL response to the antigen and to cure or at least partially arrest or slow symptoms and/or complications. An amount adequate to accomplish this is defined as "therapeutically effective dose." Amounts effective for this use will depend on, e.g., the particular composition administered, the manner of administration, the stage and severity of the disease being treated, the weight and general state of health of the patient, and the judgment of the prescribing physician.

For pharmaceutical compositions, the immunogenic peptides of the invention, or DNA encoding them, are generally administered to an individual already bearing a tumor that expresses a protein of FIG. 2. The peptides or DNA encoding them can be administered individually or as fusions of one or more peptide sequences. Patients can be treated with the immunogenic peptides separately or in conjunction with other treatments, such as surgery, as appropriate.

For therapeutic use, administration should generally begin at the first diagnosis of a protein of FIG. 2-*associated* cancer. This is followed by boosting doses until at least symptoms are substantially abated and for a period thereafter. The embodiment of the vaccine composition (i.e., including, but not limited to embodiments such as peptide cocktails, polyepitopic polypeptides, minigenes, or TAA-specific CTLs or pulsed dendritic cells) delivered to the patient may vary according to the stage of the disease or the patient's health status. For example, in a patient with a tumor that expresses a protein of FIG. 2, a vaccine comprising CTLs specific for the respective protein of FIG. 2 may be more efficacious in killing tumor cells in patient with advanced disease than alternative embodiments.

It is generally important to provide an amount of the peptide epitope delivered by a mode of administration sufficient to effectively stimulate a cytotoxic T cell response; compositions which stimulate helper T cell responses can also be given in accordance with this embodiment of the invention.

The dosage for an initial therapeutic immunization generally occurs in a unit dosage range where the lower value is about 1, 5, 50, 500, or 1,000 μg and the higher value is about 10,000; 20,000; 30,000; or 50,000 μg. Dosage values for a human typically range from about 500 μg to about 50,000 μg per 70 kilogram patient. Boosting dosages of between about 1.0 μg to about 50,000 μg of peptide pursuant to a boosting regimen over weeks to months may be administered depending upon the patient's response and condition as determined by measuring the specific activity of CTL and HTL obtained from the patient's blood. Administration should continue until at least clinical symptoms or laboratory tests indicate that the neoplasia, has been eliminated or reduced and for a period thereafter. The dosages, routes of administration, and dose schedules are adjusted in accordance with methodologies known in the art.

In certain embodiments, the peptides and compositions of the present invention are employed in serious disease states, that is, life-threatening or potentially life threatening situations. In such cases, as a result of the minimal amounts of extraneous substances and the relative nontoxic nature of the peptides in preferred compositions of the invention, it is possible and may be felt desirable by the treating physician to administer substantial excesses of these peptide compositions relative to these stated dosage amounts.

The vaccine compositions of the invention can also be used purely as prophylactic agents. Generally the dosages for an initial prophylactic immunization generally occurs in a unit dosage range where the lower value is about 1, 5, 50, 500, or 1000 μg and the higher value is about 10,000; 20,000; 30,000; or 50,000 μg. Dosage values for a human typically range from about 500 μg to about 50,000 μg per 70 kilogram patient. This is followed by boosting dosages of between about 1.0 μg to about 50,000 μg of peptide administered at defined intervals from about four weeks to six months after the initial administration of vaccine. The immunogenicity of the vaccine can be assessed by measuring the specific activity of CTL and HTL obtained from a sample of the patient's blood.

The pharmaceutical compositions for therapeutic treatment are intended for parenteral, topical, oral, nasal, intrathecal, or local (e.g. as a cream or topical ointment) administration. Preferably, the pharmaceutical compositions are administered parentally, e.g., intravenously, subcutaneously, intradermally, or intramuscularly. Thus, the invention provides compositions for parenteral administration which comprise a solution of the immunogenic peptides dissolved or suspended in an acceptable carrier, preferably an aqueous carrier.

A variety of aqueous carriers may be used, e.g., water, buffered water, 0.8% saline, 0.3% glycine, hyaluronic acid and the like. These compositions may be sterilized by conventional, well-known sterilization techniques, or may be sterile filtered. The resulting aqueous solutions may be packaged for use as is, or lyophilized, the lyophilized preparation being combined with a sterile solution prior to administration.

The compositions may contain pharmaceutically acceptable auxiliary substances as required to approximate physiological conditions, such as pH-adjusting and buffering agents, tonicity adjusting agents, wetting agents, preservatives, and the like, for example, sodium acetate, sodium lactate, sodium chloride, potassium chloride, calcium chloride, sorbitan monolaurate, triethanolamine oleate, etc.

The concentration of peptides of the invention in the pharmaceutical formulations can vary widely, i.e., from less than about 0.1%, usually at or at least about 2% to as much as 20% to 50% or more by weight, and will be selected primarily by fluid volumes, viscosities, etc., in accordance with the particular mode of administration selected.

A human unit dose form of a composition is typically included in a pharmaceutical composition that comprises a human unit dose of an acceptable carrier, in one embodiment an aqueous carrier, and is administered in a volume/quantity that is known by those of skill in the art to be used for administration of such compositions to humans (see, e.g., *Remington's Pharmaceutical Sciences,* $17^{th}$ Edition, A. Gennaro, Editor, Mack Publishing Co., Easton, Pa., 1985). For example a peptide dose for initial immunization can be from about 1 to about 50,000 μg, generally 100-5,000 μg, for a 70 kg patient. For example, for nucleic acids an initial immunization may be performed using an expression vector in the form of naked nucleic acid administered IM (or SC or ID) in the amounts of 0.5-5 mg at multiple sites. The nucleic acid (0.1 to 1000 μg) can also be administered using a gene gun. Following an incubation period of 3-4 weeks, a booster dose is then administered. The booster can be recombinant fowlpox virus administered at a dose of $5\text{-}10^7$ to $5\times10^9$ pfu.

For antibodies, a treatment generally involves repeated administration of the antibody preparation, via an acceptable route of administration such as intravenous injection (IV), typically at a dose in the range of about 0.1 to about 10 mg/kg body weight. In general, doses in the range of 10-500 mg mAb per week are effective and well tolerated. Moreover, an initial loading dose of approximately 4 mg/kg patient body weight IV, followed by weekly doses of about 2 mg/kg IV of the anti-FIG. 2 protein mAb preparation represents an acceptable dosing regimen. As appreciated by those of skill in the art, various factors can influence the ideal dose in a particular case. Such factors include, for example, half life of a composition, the binding affinity of an Ab, the immunogenicity of a substance, the degree of expression of the protein of the invention in the patient, the extent of circulating shed of protein of the invention antigen, the desired steady-state concentration level, frequency of treatment, and the influence of chemotherapeutic or other agents used in combination with the treatment method of the invention, as well as the health status of a particular patient. Non-limiting preferred human unit doses are, for example, 500 μg-1 mg, 1 mg-50 mg, 50 mg-100 mg, 100 mg-200 mg, 200 mg-300 mg, 400 mg-500 mg, 500 mg-600 mg, 600 mg-700 mg, 700 mg-800 mg, 800 mg-900 mg, 900 mg-1 g, or 1 mg-700 mg. In certain embodiments, the dose is in a range of 2-5 mg/kg body weight, e.g., with follow on weekly doses of 1-3 mg/kg; 0.5 mg, 1, 2, 3, 4, 5, 6, 7, 8, 9, 10 mg/kg body weight followed, e.g., in two, three or four weeks by weekly doses; 0.5-10 mg/kg body weight, e.g., followed in two, three or four weeks by weekly doses; 225, 250, 275, 300, 325, 350, 375, 400 mg $m^2$ of body area weekly; 1-600 mg $m^2$ of body area weekly; 225-400 mg $m^2$ of body area weekly; these does can be followed by weekly doses for 2, 3, 4, 5, 6, 7, 8, 9, 19, 11, 12 or more weeks.

In one embodiment, human unit dose forms of polynucleotides comprise a suitable dosage range or effective amount that provides any therapeutic effect. As appreciated by one of ordinary skill in the art a therapeutic effect depends on a number of factors, including the sequence of the polynucleotide, molecular weight of the polynucleotide and route of administration. Dosages are generally selected by the physician or other health care professional in accordance with a variety of parameters known in the art, such as severity of symptoms, history of the patient and the like. Generally, for a polynucleotide of about 20 bases, a dosage range may be selected from, for example, an independently selected lower limit such as about 0.1, 0.25, 0.5, 1, 2, 5, 10, 20, 30, 40, 50, 60, 70, 80, 90, 100, 200, 300, 400 or 500 mg/kg up to an independently selected upper limit, greater than the lower limit, of about 60, 80, 100, 200, 300, 400, 500, 750, 1000, 1500, 2000, 3000, 4000, 5000, 6000, 7000, 8000, 9000 or 10,000 mg/kg. For example, a dose may be about any of the following: 0.1 to 100 mg/kg, 0.1 to 50 mg/kg, 0.1 to 25 mg/kg, 0.1 to 10 mg/kg, 1 to 500 mg/kg, 100 to 400 mg/kg, 200 to 300 mg/kg, 1 to 100 mg/kg, 100 to 200 mg/kg, 300 to 400 mg/kg, 400 to 500 mg/kg, 500 to 1000 mg/kg, 500 to 5000 mg/kg, or 500 to 10,000 mg/kg. Generally, parenteral routes of administration may require higher doses of polynucleotide compared to more direct application to the nucleotide to diseased tissue, as do polynucleotides of increasing length.

In one embodiment, human unit dose forms of T-cells comprise a suitable dosage range or effective amount that provides any therapeutic effect. As appreciated by one of ordinary skill in the art, a therapeutic effect depends on a number of factors. Dosages are generally selected by the physician or other health care professional in accordance with a variety of parameters known in the art, such as severity of symptoms, history of the patient and the like. A dose may be about $10^4$ cells to about $10^6$ cells, about $10^6$ cells to about $10^8$ cells, about $10^8$ to about $10^{11}$ cells, or about $10^8$ to about $5\times10^{10}$ cells. A dose may also about $10^6$ cells/$m^2$ to about $10^{10}$ cells/$m^2$, or about $10^6$ cells/$m^2$ to about $10^8$ cells/$m^2$.

Proteins(s) of the invention, and/or nucleic acids encoding the protein(s), can also be administered via liposomes, which may also serve to: 1) target the proteins(s) to a particular tissue, such as lymphoid tissue; 2) to target selectively to diseases cells; or, 3) to increase the half-life of the peptide composition. Liposomes include emulsions, foams, micelles, insoluble monolayers, liquid crystals, phospholipid dispersions, lamellar layers and the like. In these preparations, the peptide to be delivered is incorporated as part of a liposome, alone or in conjunction with a molecule which binds to a receptor prevalent among lymphoid cells, such as monoclonal antibodies which bind to the CD45 antigen, or with other therapeutic or immunogenic compositions. Thus, liposomes either filled or decorated with a desired peptide of the invention can be directed to the site of lymphoid cells, where the liposomes then deliver the peptide compositions. Liposomes for use in accordance with the invention are formed from standard vesicle-forming lipids, which generally include neutral and negatively charged phospholipids and a sterol, such as cholesterol. The selection of lipids is generally guided by consideration of, e.g., liposome size, acid lability and stability of the liposomes in the blood stream. A variety of methods are available for preparing liposomes, as described in, e.g., Szoka, et al., *Ann. Rev. Biophys. Bioeng.* 9:467 (1980), and U.S. Pat. Nos. 4,235,871, 4,501,728, 4,837,028, and 5,019,369.

For targeting cells of the immune system, a ligand to be incorporated into the liposome can include, e.g., antibodies or fragments thereof specific for cell surface determinants of the desired immune system cells. A liposome suspension containing a peptide may be administered intravenously, locally, topically, etc. in a dose which varies according to, inter alia, the manner of administration, the peptide being delivered, and the stage of the disease being treated.

For solid compositions, conventional nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10-95% of active ingredient, that is, one or more peptides of the invention, and more preferably at a concentration of 25%-75%.

For aerosol administration, immunogenic peptides are preferably supplied in finely divided form along with a surfactant and propellant. Typical percentages of peptides are about 0.01%-20% by weight, preferably about 1%-10%. The surfactant must, of course, be nontoxic, and preferably soluble in the propellant. Representative of such agents are the esters or partial esters of fatty acids containing from about 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute about 0.1%-20% by weight of the composition, preferably about 0.25-5%. The balance of the composition is ordinarily propellant. A carrier can also be included, as desired, as with, e.g., lecithin for intranasal delivery.

XI.) Diagnostic and Prognostic Embodiments of the Invention.

As disclosed herein, polynucleotides, polypeptides, reactive cytotoxic T cells (CTL), reactive helper T cells (HTL) and anti-polypeptide antibodies of the invention are used in well known diagnostic, prognostic and therapeutic assays that examine conditions associated with dysregulated cell growth such as cancer, in particular the cancers listed in Table I (see, e.g., both its specific pattern of tissue expression as well as its overexpression in certain cancers as described for example in Example 4).

Proteins of FIG. 2 can be analogized to the prostate associated antigen PSA, the archetypal marker that has been used by medical practitioners for years to identify and monitor the presence of prostate cancer (see, e.g., Merrill et al., J. Urol. 163(2): 503-5120 (2000); Polascik et al., J. Urol. August; 162(2):293-306 (1999) and Fortier et al., J. Nat. Cancer Inst. 91(19): 1635-1640(1999)). A variety of other diagnostic markers are also used in similar contexts including p53 and K-ras (see, e.g., Tulchinsky et al., Int J Mol Med 1999 July 4(1):99-102 and Minimoto et al., Cancer Detect Prev 2000; 24(1):1-12). Therefore, this disclosure of FIG. 2 polynucleotides and polypeptides (as well as FIG. 2-*related* polynucleotide probes and anti-FIG. 2 protein antibodies used to identify the presence of these molecules) and their properties allows skilled artisans to utilize these molecules in methods that are analogous to those used, for example, in a variety of diagnostic assays directed to examining conditions associated with cancer.

Typical embodiments of diagnostic methods, which utilize the polynucleotides, polypeptides, reactive T cells and antibodies of the invention, are analogous to those methods from well-established diagnostic assays which employ, e.g., PSA polynucleotides, polypeptides, reactive T cells and antibodies. For example, just as PSA polynucleotides are used as probes (for example in Northern analysis, see, e.g., Sharief et al., Biochem. Mol. Biol. Int. 33(3):567-74(1994)) and primers (for example in PCR analysis, see, e.g., Okegawa et al., J. Urol. 163(4): 1189-1190 (2000)) to observe the presence and/or the level of PSA mRNAs in methods of monitoring PSA overexpression or the metastasis of prostate cancers, the FIG. 2 polynucleotides described herein can be utilized in the same way to detect the respective FIG. 2 protein overexpression or the metastasis of prostate and other cancers expressing this gene. Alternatively, just as PSA polypeptides are used to generate antibodies specific for PSA which can then be used to observe the presence and/or the level of PSA proteins in methods to monitor PSA protein overexpression (see, e.g., Stephan et al., Urology 55(4):560-3 (2000)) or the metastasis of prostate cells (see, e.g., Alanen et al., Pathol. Res. Pract. 192(3):233-7 (1996)), the FIG. 2 polypeptides described herein can be utilized to generate antibodies for use in detecting the respective proteins of FIG. 2 overexpression or the metastasis of prostate cells and cells of other cancers expressing this gene.

Specifically, because metastases involves the movement of cancer cells from an organ of origin (such as the lung or prostate gland etc.) to a different area of the body (such as a lymph node), assays which examine a biological sample for the presence of cells expressing FIG. 2 polynucleotides and/or polypeptides can be used to provide evidence of metastasis. For example, when a biological sample from tissue that does not normally contain gene or protein of FIG. 2-*expressing* cells (e.g., a lymph node) is found to contain a protein of FIG. 2-*expressing* cells, this finding is indicative of metastasis.

Alternatively polynucleotides and/or polypeptides of the invention can be used to provide evidence of cancer, for example, when cells in a biological sample that do not normally express FIG. 2 genes or express FIG. 2 genes at a different level are found to express FIG. 2 genes or have an increased expression of FIG. 2 genes (see, e.g., the expression in the cancers of tissues listed in Table I and in patient samples etc. shown in the accompanying Figures). In such assays, artisans may further wish to generate supplementary evidence of metastasis by testing the biological sample for the presence of a second tissue restricted marker (in addition to a protein of FIG. 2) such as PSA, PSCA etc. (see, e.g., Alanen et al., Pathol. Res. Pract. 192(3): 233-237 (1996)).

Just as PSA polynucleotide fragments and polynucleotide variants are employed by skilled artisans for use in methods of monitoring PSA, a gene of FIG. 2 polynucleotide fragments and polynucleotide variants are used in an analogous manner. In particular, typical PSA polynucleotides used in methods of monitoring PSA are probes or primers which consist of fragments of the PSA cDNA sequence. Illustrating this, primers used to PCR amplify a PSA polynucleotide must include less than the whole PSA sequence to function in the polymerase chain reaction. In the context of such PCR reactions, skilled artisans generally create a variety of different polynucleotide fragments that can be used as primers in order to amplify different portions of a polynucleotide of interest or to optimize amplification reactions (see, e.g., Caetano-Anolles, G. Biotechniques 25(3): 472-476, 478-480 (1998); Robertson et al., Methods Mot. Biol. 98:121-154 (1998)). An additional illustration of the use of such fragments is provided in Example 4, where a gene of FIG. 2 polynucleotide fragments are used as a probe to show the expression of respective gene of FIG. 2 RNAs in cancer cells. In addition, variant polynucleotide sequences are typically used as primers and probes for the corresponding mRNAs in PCR and Northern analyses (see, e.g., Sawai et al., Fetal Diagn. Ther. 1996 November-December 11(6):407-13 and Current Protocols In Molecular Biology, Volume 2, Unit 2, Frederick M. Ausubel et al. eds., 1995)). Polynucleotide fragments and variants are useful in this context where they are capable of binding to a target polynucleotide sequence (e.g., a FIG. 2 polynucleotide or variant thereof) under conditions of high stringency.

Furthermore, PSA polypeptides which contain an epitope that can be recognized by an antibody or T cell that specifically binds to that epitope are used in methods of monitoring PSA. Polypeptide fragments, polypeptide analogs or variants of a protein of FIG. 2 can also be used in an analogous manner.

This practice of using polypeptide fragments or polypeptide variants to generate antibodies (such as anti-PSA antibodies or T cells) is typical in the art with a wide variety of systems such as fusion proteins being used by practitioners (see, e.g., Current Protocols In Molecular Biology, Volume 2, Unit 16, Frederick M. Ausubel et al. eds., 1995). In this context, each epitope(s) functions to provide the architecture with which an antibody or T cell is reactive. Typically, skilled artisans create a variety of different polypeptide fragments that can be used in order to generate immune responses specific for different portions of a polypeptide of interest (see, e.g., U.S. Pat. No. 5,840,501 and U.S. Pat. No. 5,939,533). For example it may be preferable to utilize a polypeptide comprising one of the biological motifs of a protein of FIG. 2 discussed herein or a motif-bearing subsequence which is readily identified by one of skill in the art based on motifs available in the art. Polypeptide fragments, variants or analogs are typically useful in this context as long as they comprise an epitope capable of generating an antibody or T cell specific for a target polypeptide sequence (e.g. a protein of FIG. 2).

As shown herein, the FIG. 2 polynucleotides and polypeptides (as well as the FIG. 2 polynucleotide probes and anti-proteins of FIG. 2 antibodies or T cells used to identify the presence of these molecules) exhibit specific properties that make them useful in diagnosing cancers such as those listed in Table I. Diagnostic assays that measure the presence of gene of FIG. 2 gene products, in order to evaluate the presence or onset of a disease condition described herein, such as prostate cancer, are used to identify patients for preventive measures or further monitoring, as has been done so successfully with PSA. Moreover, these materials satisfy a need in the art for molecules having similar or complementary characteristics to PSA in situations where, for example, a definite diagnosis of metastasis of prostatic origin cannot be made on the basis of a test for PSA alone (see, e.g., Alanen et al., Pathol. Res. Pract. 192(3): 233-237 (1996)), and consequently, materials such as FIG. 2 polynucleotides and polypeptides (as well as the gene of FIG. 2 polynucleotide probes and anti-proteins of FIG. 2 antibodies used to identify the presence of these molecules) need to be employed to confirm a metastases of prostatic origin.

Finally, in addition to their use in diagnostic assays, the FIG. 2 polynucleotides disclosed herein have a number of other utilities such as their use in the identification of oncogenetic associated chromosomal abnormalities in the chromosomal region to which a FIG. 2 gene maps (see Example 3 below). Moreover, in addition to their use in diagnostic assays, the FIG. 2-*related* proteins and polynucleotides disclosed herein have other utilities such as their use in the forensic analysis of tissues of unknown origin (see, e.g., Takahama K Forensic Sci Int 1996 Jun. 28; 80(1-2): 63-9).

Additionally, FIG. 2-*related* proteins or polynucleotides of the invention can be used to treat a pathologic condition characterized by the over-expression of FIG. 2 proteins. For example, the amino acid or nucleic acid sequences in FIG. 2 or FIG. 3, or fragments of either, can be used to generate an immune response to a protein of FIG. 2 antigen. Antibodies or other molecules that react with proteins of the invention FIG. 2 can be used to modulate the function of this molecule, and thereby provide a therapeutic benefit.

XII.) Inhibition of the Function of a Protein in the Invention

The invention includes various methods and compositions for inhibiting the binding of proteins in FIG. 2 to its binding partner or its association with other protein(s) as well as methods for inhibiting the function of proteins in FIG. 2.

XII.A.) Inhibition of a Protein of FIG. 2 with Intracellular Antibodies

In one approach, a recombinant vector that encodes single chain antibodies that specifically bind to a FIG. 2 protein are introduced into proteins of FIG. 2 expressing cells via gene transfer technologies. Accordingly, the encoded single chain anti-protein of FIG. 2 antibodies are expressed intracellularly, and bind to the respective FIG. 2 protein, and thereby inhibits its function. Methods for engineering such intracellular single chain antibodies are well known. Such intracellular antibodies, also known as “intrabodies”, are specifically targeted to a particular compartment within the cell, providing control over where the inhibitory activity of the treatment is focused. This technology has been successfully applied in the art (for review, see Richardson and Marasco, 1995, TIBTECH vol. 13). Intrabodies have been shown to virtually eliminate the expression of otherwise abundant cell surface receptors (see, e.g., Richardson et al., 1995, Proc. Natl. Acad. Sci. USA 92: 3137-3141; Beerli et al., 1994, J. Biol. Chem. 289: 23931-23936; Deshane et al., 1994, Gene Ther. 1: 332-337).

Single chain antibodies comprise the variable domains of the heavy and light chain joined by a flexible linker polypeptide, and are expressed as a single polypeptide. Optionally, single chain antibodies are expressed as a single chain variable region fragment joined to the light chain constant region. Well-known intracellular trafficking signals are engineered into recombinant polynucleotide vectors encoding such single chain antibodies in order to precisely target the intrabody to the desired intracellular compartment. For example, intrabodies targeted to the endoplasmic reticulum (ER) are engineered to incorporate a leader peptide and, optionally, a C-terminal ER retention signal, such as the KDEL amino acid motif. Intrabodies intended to exert activity in the nucleus are engineered to include a nuclear localization signal. Lipid moieties are joined to intrabodies in order to tether the intrabody to the cytosolic side of the plasma membrane. Intrabodies can also be targeted to exert function in the cytosol. For example, cytosolic intrabodies are used to sequester factors within the cytosol, thereby preventing them from being transported to their natural cellular destination.

In one embodiment, intrabodies are used to capture proteins of FIG. 2 in the nucleus, thereby preventing the activity of that protein(s) within the nucleus. Nuclear targeting signals are engineered into such FIG. 2-*related* intrabodies in order to achieve the desired targeting. Such FIG. 2-*related* intrabodies are designed to bind specifically to a particular FIG. 2 protein domain. In another embodiment, cytosolic intrabodies that specifically bind to a FIG. 2 protein are used to prevent the protein in FIG. 2 from gaining access to the nucleus, thereby preventing it from exerting any biological activity within the nucleus (e.g., preventing proteins of FIG. 2 from forming transcription complexes with other factors).

In order to specifically direct the expression of such intrabodies to particular cells, the transcription of the intrabody is placed under the regulatory control of an appropriate tumor-specific promoter and/or enhancer. In order to target intrabody expression specifically to prostate, for example, the PSA promoter and/or promoter/enhancer can be utilized (See, for example, U.S. Pat. No. 5,919,652 issued 6 Jul. 1999).

XII.B.) Inhibition of a Protein of FIG. 2 with Recombinant Proteins

In another approach, recombinant molecules bind to a FIG. 2 protein and thereby inhibit the function of a protein of FIG. 2. For example, these recombinant molecules prevent or inhibit FIG. 2 proteins from accessing/binding to its binding partner(s) or associating with other protein(s). Such recombinant molecules can, for example, contain the reactive part (s) of an antibody molecule specific for a protein of FIG. 2. In a particular embodiment, the FIG. 2 protein binding domain of a corresponding binding partner is engineered into a dimeric fusion protein, whereby the fusion protein comprises two protein of FIG. 2 ligand binding domains linked to the Fc portion of a human IgG, such as human IgG1. Such IgG portion can contain, for example, the $C_H2$ and $C_H3$ domains and the hinge region, but not the $C_H1$ domain. Such dimeric fusion proteins are administered in soluble form to patients suffering from a cancer associated with the expression of proteins of the invention, see, e.g., FIG. 2, whereby the dimeric fusion protein specifically binds to a FIG. 2 protein and blocks the interaction of a FIG. 2 protein with one or more binding partners. Such dimeric fusion proteins are further combined into multimeric proteins using known antibody linking technologies.

XII.C.) Inhibition of Transcription or Translation in Accordance with the Invention The present invention also comprises various methods and compositions for inhibiting the transcription of a FIG. 2 gene. Similarly, the invention also provides methods and compositions for inhibiting the translation of the genes in FIG. 2-*related* mRNA into protein.

In one approach, a method of inhibiting the transcription of a FIG. 2 gene comprises contacting the FIG. 2 gene with a respective FIG. 2 antisense polynucleotide. In another approach, a method of inhibiting gene of FIG. 2-*related* mRNA translation comprises contacting a gene of FIG. 2-*related* mRNA with an antisense polynucleotide. In another approach, a gene of FIG. 2 specific ribozyme is used to cleave a gene of FIG. 2-*related* message, thereby inhibiting translation. Such antisense and ribozyme based methods can also be directed to the regulatory regions of a FIG. 2 gene, such as a promoter and/or enhancer element for a gene of FIG. 2. Similarly, proteins capable of inhibiting agene of FIG. 2 transcription factor are used to inhibit the gene of FIG. 2 mRNA transcription. The various polynucleotides and compositions useful in the aforementioned methods have been described above. The use of antisense and ribozyme molecules to inhibit transcription and translation is well known in the art.

Other factors that inhibit the transcription of a FIG. 2 gene by interfering with that gene's transcriptional activation are also useful to treat cancers expressing genes of FIG. 2. Similarly, factors that interfere with a gene of FIG. 2 gene processing are useful to treat cancers that express genes of FIG. 2. Cancer treatment methods utilizing such factors are also within the scope of the invention.

XII.D.) General Considerations for Therapeutic Strategies

Gene transfer and gene therapy technologies can be used to deliver therapeutic polynucleotide molecules to tumor cells synthesizing proteins of the invention, see, e.g., FIG. 2, (e.g., antisense, ribozyme, polynucleotides encoding intrabodies and other gene/protein of FIG. 2 inhibitory molecules). A number of gene therapy approaches are known in the art. Recombinant vectors encoding FIG. 2 antisense polynucleotides, ribozymes, factors capable of interfering with transcription of a gene of FIG. 2, and so forth, can be delivered to target tumor cells using such gene therapy approaches.

The above therapeutic approaches can be combined with any one of a wide variety of surgical, chemotherapy or radiation therapy regimens. The therapeutic approaches of the invention can enable the use of reduced dosages of chemotherapy (or other therapies) and/or less frequent administration, an advantage for all patients and particularly for those that do not tolerate the toxicity of the chemotherapeutic agent well.

The anti-tumor activity of a particular composition (e.g., antisense, ribozyme, intrabody), or a combination of such compositions, can be evaluated using various in vitro and in vivo assay systems. In vitro assays that evaluate therapeutic activity include cell growth assays, soft agar assays and other assays indicative of tumor promoting activity, binding assays capable of determining the extent to which a therapeutic composition will inhibit the binding of a protein of FIG. 2 to one or more of its binding partners, etc.

In vivo, the effects of a therapeutic composition of the invention can be evaluated in a suitable animal model. For example, xenogenic prostate cancer models can be used, wherein human prostate cancer explants or passaged xenograft tissues are introduced into immune compromised animals, such as nude or SCID mice (Klein et al., 1997, Nature Medicine 3: 402-408). For example, PCT Patent Application WO98/16628 and U.S. Pat. No. 6,107,540 describe various xenograft models of human prostate cancer capable of recapitulating the development of primary tumors, micrometastasis, and the formation of osteoblastic metastases characteristic of late stage disease. Efficacy can be predicted using assays that measure inhibition of tumor formation, tumor regression or metastasis, and the like.

In vivo assays that evaluate the promotion of apoptosis are useful in evaluating therapeutic compositions. In one embodiment, xenografts from tumor bearing mice treated with the therapeutic composition can be examined for the presence of apoptotic foci and compared to untreated control xenograft-bearing mice. The extent to which apoptotic foci are found in the tumors of the treated mice provides an indication of the therapeutic efficacy of the composition.

The therapeutic compositions used in the practice of the foregoing methods can be formulated into pharmaceutical compositions comprising a carrier suitable for the desired delivery method. Suitable carriers include any material that when combined with the therapeutic composition retains the anti-tumor function of the therapeutic composition and is generally non-reactive with the patient's immune system. Examples include, but are not limited to, any of a number of standard pharmaceutical carriers such as sterile phosphate buffered saline solutions, bacteriostatic water, and the like (see, generally, Remington's Pharmaceutical Sciences $16^{th}$ Edition, A. Osal., Ed., 1980).

Therapeutic formulations can be solubilized and administered via any route capable of delivering the therapeutic composition to the tumor site. Potentially effective routes of administration include, but are not limited to, intravenous, parenteral, intraperitoneal, intramuscular, intratumor, intradermal, intraorgan, orthotopic, and the like. A preferred formulation for intravenous injection comprises the therapeutic composition in a solution of preserved bacteriostatic water, sterile unpreserved water, and/or diluted in polyvinylchloride or polyethylene bags containing 0.9% sterile Sodium Chloride for Injection, USP. Therapeutic protein preparations can be lyophilized and stored as sterile powders, preferably under vacuum, and then reconstituted in bacteriostatic water (containing for example, benzyl alcohol preservative) or in sterile water prior to injection.

Dosages and administration protocols for the treatment of cancers using the foregoing methods will vary with the method and the target cancer, and will generally depend on a number of other factors appreciated in the art.

XIII.) Kits

For use in the diagnostic and therapeutic applications described herein, kits are also within the scope of the invention. Such kits can comprise a carrier, package or container that is compartmentalized to receive one or more containers such as vials, tubes, and the like, each of the container(s) comprising one of the separate elements to be used in the method. For example, the container(s) can comprise a probe that is or can be detectably labeled. Such probe can be an antibody or polynucleotide specific for a FIG. 2-*related* protein or a FIG. 2 gene or message, respectively. Where the method utilizes nucleic acid hybridization to detect the target nucleic acid, the kit can also have containers containing nucleotide(s) for amplification of the target nucleic acid sequence and/or a container comprising a reporter-means, such as a biotin-binding protein, such as avidin or streptavidin, bound to a reporter molecule, such as an enzymatic, florescent, or radioisotope label. The kit can include all or part of the amino acid sequences in FIG. 2 or FIG. 3 or analogs thereof, or a nucleic acid molecules that encodes such amino acid sequences.

The kit of the invention will typically comprise the container described above and one or more other containers comprising materials desirable from a commercial and user standpoint, including buffers, diluents, filters, needles, syringes; carrier, package, container, vial and/or tube labels listing contents and/or instructions for use, and package inserts with instructions for use.

A label can be present on the container to indicate that the composition is used for a specific therapy or non-therapeutic application, and can also indicate directions for either in vivo or in vitro use, such as those described above. Directions and or other information can also be included on an insert which is included with the kit.

EXAMPLES

Various aspects of the invention are further described and illustrated by way of the several examples that follow, none of which are intended to limit the scope of the invention.

Example 1

SSH-Generated Isolation of a cDNA Fragment of the Target of the Invention Gene The suppression subtractive hybridization (SSH) cDNA fragments shown in FIG. 1 were derived from many different subtractions utilizing LAPC xenografts in differing states of androgen dependence and/or castration as well as using cancer patient derived tissues. The cancer patient tissue SSHs utilized prostate, bladder, and kidney with tumors representing all stages and grades of the diseases. Information for additional sequences disclosed in FIG. 2 and FIG. 3 were derived from other clones and the use of various sequence databases.

Materials and Methods

LAPC Xenografts and Human Tissues:

LAPC xenografts were obtained from Dr. Charles Sawyers (UCLA) and generated as described (Klein et al., 1997, Nature Med. 3: 402-408; Craft et al., 1999, Cancer Res. 59: 5030-5036). Androgen dependent and independent LAPC xenografts were grown in male SCID mice and were passaged as small tissue chunks in recipient males. LAPC xenografts were derived from LAPC tumors. To generate the androgen independent (AI) xenografts, male mice bearing androgen dependent (AD) tumors were castrated and maintained for 2-3 months. After the tumors re-grew, the tumors were harvested and passaged in castrated males or in female SCID mice. Tissues from prostate, bladder, kidney, colon, lung, pancreas, ovary and breast cancer patients as well as the corresponding normal tissues were stored frozen at −70 C prior to RNA isolation.

RNA Isolation:

Tumor tissue and cell lines were homogenized in Trizol reagent (Life Technologies, Gibco BRL) using 10 ml/g tissue or 10 ml/$10^8$ cells to isolate total RNA. Poly A RNA was purified from total RNA using Qiagen's Oligotex mRNA Mini and Midi kits. Total and mRNA were quantified by spectrophotometric analysis (O.D. 260/280 nm) and analyzed by gel electrophoresis.

Oligonucleotides:

The following HPLC purified oligonucleotides were used.

DPNCDN (cDNA synthesis primer): (SEQ ID NO: 178)
5'TTTTGATCAAGCTT$_{30}$3'

Adaptor 1: (SEQ ID NO: 179)
5'CTAATACGACTCACTATAGGGCTCGAGCGGCCGCCCGGGCAG3'

(SEQ ID NO: 180)
3'GGCCCGTCCTAG5'

Adaptor 2: (SEQ ID NO: 181)
5'GTAATACGACTCACTATAGGGCAGCGTGGTCGCGGCCGAG3'

(SEQ ID NO: 182)
3'CGGCTCCTAG5'

PCR primer 1: (SEQ ID NO: 183)
5'CTAATACGACTCACTATAGGGC3'

Nested primer (NP)1: (SEQ ID NO: 184)
5'TCGAGCGGCCGCCCGGGCAGGA3'

Nested primer (NP)2: (SEQ ID NO: 185)
5'AGCGTGGTCGCGGCCGAGGA3'

Suppression Subtractive Hybridization:

Suppression Subtractive Hybridization (SSH) was used to identify cDNAs corresponding to genes that are differentially expressed in cancer. The SSH reaction utilized cDNA from the prostate cancer xenografts, LAPC-4 AD, LAPC-4 AI, LAPC-9 AD, and LAPC-9AI as well as from prostate, bladder, and kidney cancer patients. Specifically, to isolate genes that are involved in the progression of androgen dependent (AD) prostate cancer to androgen independent (AI) cancer, experiments were conducted with the LAPC-9 AD and LAPC-4 AD xenograft in male SCID mice. Mice that harbored these xenografts were castrated when the tumors reached a size of 1 cm in diameter. The tumors regressed in size and temporarily stopped producing the androgen dependent protein PSA. Seven to fourteen days post-castration, PSA levels were detectable again in the blood of the mice. Eventually the tumors develop an AI phenotype and start growing again in the castrated males. Tumors were harvested at different time points after castration to identify genes that are turned on or off during the transition to androgen independence.

The cDNAs derived from LAPC-4 AD and LAPC-9 AD tumors (post-castration) were used as the source of the "tester" cDNAs, while the cDNAs from LAPC4-AD and LAPC-9 AD tumors (grown in intact male mouse) were used as the source of the "driver" cDNAs respectively. Some SSHs also used any combination of the LAPC-4 AD, LAPC-4 AI, LAPC-9AD, and LAPC9-AI xenografts as "tester" or "driver". In addition, cDNAs derived from patient tumors of prostate, bladder and kidney cancer were used as "tester" while cDNAs derived from normal prostate, bladder, and kidney were used as "driver" respectively. Double stranded cDNAs corresponding to tester and driver cDNAs were synthesized from 2 μg of poly(A)$^+$ RNA isolated from the relevant xenograft tissue, as described above, using CLONTECH's PCR-Select cDNA Subtraction Kit and 1 ng of oligonucleotide DPNCDN as primer. First- and second-strand synthesis were carried out as described in the Kit's user manual protocol (CLONTECH Protocol No. PT1117-1, Catalog No. K1804-1). The resulting cDNA was digested with Dpn II for 3 hrs at 37° C. Digested cDNA was extracted with phenol/chloroform (1:1) and ethanol precipitated.

Tester cDNA was generated by diluting 1 μl of Dpn II digested cDNA from the relevant xenograft source (see above) (400 ng) in 5 μl of water. The diluted cDNA (2 μl, 160 ng) was then ligated to 2 μl of Adaptor 1 and Adaptor 2 (10 μM), in separate ligation reactions, in a total volume of 10 μl at 16° C. overnight, using 400 u of T4 DNA ligase (CLONTECH). Ligation was terminated with 1 μl of 0.2 M EDTA and heating at 72° C. for 5 min.

The first hybridization was performed by adding 1.5 μl (600 ng) of driver cDNA to each of two tubes containing 1.5 μl (20 ng) Adaptor 1- and Adaptor 2-ligated tester cDNA. In a final volume of 4 μl, the samples were overlaid with mineral oil, denatured in an MJ Research thermal cycler at 98° C. for 1.5 minutes, and then were allowed to hybridize for 8 hrs at 68° C. The two hybridizations were then mixed together with an additional 1 μl of fresh denatured driver cDNA and were allowed to hybridize overnight at 68° C. The second hybridization was then diluted in 200 μl of 20 mM Hepes, pH 8.3, 50 mM NaCl, 0.2 mM EDTA, heated at 70° C. for 7 min. and stored at −20° C.

PCR Amplification, Cloning and Sequencing of Gene Fragments Generated from SSH:

To amplify gene fragments resulting from SSH reactions, two PCR amplifications were performed. In the primary PCR reaction 1 μl of the diluted final hybridization mix was added to 1 μl of PCR primer 1 (10 μM), 0.5 μl dNTP mix (10 μM), 2.5 μl 10×reaction buffer (CLONTECH) and 0.5 μl 50×Advantage cDNA polymerase Mix (CLONTECH) in a final volume of 25 μl. PCR 1 was conducted using the following conditions: 75° C. for 5 min., 94° C. for 25 sec., then 27 cycles of 94° C. for 10 sec, 66° C. for 30 sec, 72° C. for 1.5 min. Five separate primary PCR reactions were performed for each experiment. The products were pooled and diluted 1:10 with water. For the secondary PCR reaction, 1 μl from the pooled and diluted primary PCR reaction was added to the same reaction mix as used for PCR 1, except that primers NP1 and NP2 (10 μM) were used instead of PCR primer 1. PCR 2 was performed using 10-12 cycles of 94° C. for 10 sec, 68° C. for 30 sec, and 72° C. for 1.5 minutes. The PCR products were analyzed using 2% agarose gel electrophoresis.

The PCR products were inserted into pCR2.1 using the T/A vector cloning kit (Invitrogen). Transformed *E. coli* were subjected to blue/white and ampicillin selection. White colonies were picked and arrayed into 96 well plates and were grown in liquid culture overnight. To identify inserts, PCR amplification was performed on 1 μl of bacterial culture using the conditions of PCR1 and NP1 and NP2 as primers. PCR products were analyzed using 2% agarose gel electrophoresis.

Bacterial clones were stored in 20% glycerol in a 96 well format. Plasmid DNA was prepared, sequenced, and subjected to nucleic acid homology searches of the GenBank, dBest, and NCI-CGAP databases.

A full-length cDNA clone can be identified by assembling EST fragments homologous to the SSH fragment into a large contiguous sequence with an ORF and amplifying the ORF by PCR using xenograft, prostate, bladder, kidney, prostate cancer, bladder cancer, or kidney cancer first strand cDNA.

Example 2

Full Length Cloning of a Target of the Invention

Full length cDNA clones were isolated by a variety of methods known in the art. For example, cDNA phage libraries were constructed from normal and cancer tissues using methods based on those set forth in Current Protocols in Molecular Biology, Ed Ausubel et al., page 5.01, to 5.11.1, through supplement 52, Wiley and Sons; Molecular Cloning, 2$^{nd}$ Edition, Sambrook et al. Eds, pp. 8.2 to 8.45, 1989, Cold Spring Harbor Press) and full length cDNA clone isolated using probes derived from SSH clones and methods based on (Ausubel et al., supra, pp. 6.0.1 to 6.5.2; Sambrook et al. Eds, supra, 1989, pp. 8.46 to 8.86). In addition, some full length cDNAs were cloned using PCR with primers derived from the extreme ends of ORFs identified in ESTs assembled into contigs. The PCR product is subsequently cloned into pCR2.1 cloning vector (Invitrogen, Carlsbad, Calif.). Sequences of the cloned genes are listed in FIG. 2.

Example 3

Chromosomal Mapping

Chromosomal localization can implicate genes in disease pathogenesis. Several chromosome mapping approaches are available including fluorescent in situ hybridization (FISH), human/hamster radiation hybrid (RH) panels (Walter et al., 1994; Nature Genetics 7:22; Research Genetics, Huntsville Al), human-rodent somatic cell hybrid panels such as is available from the Coriell Institute (Camden, N.J.), and genomic viewers utilizing BLAST homologies to sequenced and mapped genomic clones (NCBI, Bethesda, Md.).

Using FIG. 2 gene sequences and the NCBI BLAST tool, placed the genes of FIG. 2 to the chromosome locations listed in Table XXII.

Accordingly, as the human genes set forth in FIG. 2 map to the designated chromosomes, polynucleotides encoding different regions of the of FIG. 2 protein can be used to characterize cytogenetic abnormalities on a respective chromosome For example, when chromosomal abnormalities in a chromosome listed in Table XXII have been identified as frequent cytogenetic abnormalities in different cancers (see, e.g., Lai et al., 2000, Clin. Cancer Res. 6(8):3172-6; Oya and Schulz, 2000, Br. J. Cancer 83(5):626-31; Svaren et al., Sep. 12, 2000, J. Biol. Chem.); polynucleotides encoding specific regions of the of a FIG. 2 protein provide new tools that are used to delineate, with greater precision than previously possible, the specific nature of the cytogenetic abnormalities in this region of the respective chromosome that contribute to the malignant phenotype. In this context, these polynucleotides satisfy a need in the art for expanding the sensitivity of chromosomal screening in order to identify more subtle and less common chromosomal abnormalities (see, e.g., Evans et al., 1994, Am. J. Obstet. Gynecol. 171(4):1055-1057).

Example 4

Expression Analysis of a Gene of the Invention in Normal Tissues and Patient Specimens Expression analysis by RT-PCR and Northern analysis demonstrated that normal tissue expression of a gene of FIG. 2 is restricted predominantly to the tissues set forth in Table I.

Therapeutic applications for a gene of FIG. 2 include use as a small molecule therapy and/or a vaccine (T cell or antibody) target. Diagnostic applications for a gene of FIG. 2 include use as a diagnostic marker for local and/or metastasized disease. The restricted expression of a gene of FIG. 2 in normal tissues makes it useful as a tumor target for diagnosis and therapy. Expression analysis of a gene of FIG. 2 provides information useful for predicting susceptibility to advanced stage disease, rate of progression, and/or tumor aggressiveness. Expression status of a gene of FIG. 2 in patient samples, tissue arrays and/or cell lines may be analyzed by: (i) immunohistochemical analysis; (ii) in situ hybridization; (iii) RT-PCR analysis on laser capture micro-dissected samples; (iv) Western blot analysis; and (v) Northern analysis.

RT-PCR analysis and Northern blotting were used to evaluate gene expression in a selection of normal and cancerous urological tissues. The results are summarized in FIGS. 15-74.

RT-PCR Expression Analysis:

First strand cDNAs can be generated from 1 μg of mRNA with oligo (dT)12-18 priming using the Gibco-BRL Superscript Preamplification system. The manufacturer's protocol was used which included an incubation for 50 min at 42° C. with reverse transcriptase followed by RNAse H treatment at 37° C. for 20 min. After completing the reaction, the volume can be increased to 200 μl with water prior to normalization. First strand cDNAs from 16 different normal human tissues can be obtained from Clontech.

Normalization of the first strand cDNAs from multiple tissues was performed by using the primers 5'atatcgccgcgctcgtcgtcgacaa3' (SEQ ID NO: 186) and 5'agccacacgcagctcattgtagaagg 3' (SEQ ID NO: 187) to amplify β-actin. First strand cDNA (5 μl) were amplified in a total volume of 50 μl containing 0.4 μM primers, 0.2 μM each dNTPs, 1×PCR buffer (Clontech, 10 mM Tris-HCL, 1.5 mM $MgCl_2$, 50 mM KCl, pH8.3) and 1× Klentaq DNA polymerase (Clontech). Five μl of the PCR reaction can be removed at 18, 20, and 22 cycles and used for agarose gel electrophoresis. PCR was performed using an MJ Research thermal cycler under the following conditions: Initial denaturation can be at 94° C. for 15 sec, followed by a 18, 20, and 22 cycles of 94° C. for 15, 65° C. for 2 min, 72° C. for 5 sec. A final extension at 72° C. was carried out for 2 min. After agarose gel electrophoresis, the band intensities of the 283 b.p. β-actin bands from multiple tissues were compared by visual inspection. Dilution factors for the first strand cDNAs were calculated to result in equal β-actin band intensities in all tissues after 22 cycles of PCR. Three rounds of normalization can be required to achieve equal band intensities in all tissues after 22 cycles of PCR.

To determine expression levels of the gene, 5 μl of normalized first strand cDNA are analyzed by PCR using 26, and 30 cycles of amplification. Semi-quantitative expression analysis can be achieved by comparing the PCR products at cycle numbers that give light band intensities. RT-PCR expression analysis is performed on first strand cDNAs generated using pools of tissues from multiple samples. The cDNA normalization was demonstrated in every experiment using beta-actin PCR.

Northern Blot Expression Analysis:

Expression of mRNA in normal and cancerous human tissues was analyzed by northern blotting. Expression in normal tissues was analyzed using two multiple tissue blots (Clontech; Palo Alto, Calif.), comprising a total of 16 different normal human tissues, using labeled SSH fragment as a probe. To further analyze expression in prostate cancer tissues, northern blotting was performed on RNA derived from the LAPC xenografts and/or prostate cancer patient samples. In addition, expression in other cancers was studied using patient samples and/or various cancer cell lines.

FIG. 15 shows expression of 74P3B3 by RT-PCR. First strand cDNA was prepared from vital pool 1 (liver, lung and kidney), vital pool 2 (pancreas, colon and stomach), two prostate metastasis to lymph node (LN) harvested from two different patients, prostate cancer pool, bladder cancer pool, and cancer metastasis pool. Normalization was performed by PCR using primers to actin and GAPDH. Semi-quantitative PCR, using primers to 74P3B3, was performed at 26 and 30 cycles of amplification. Results show strong expression of 74P3B3 in the two prostate metastasis to LN specimens and in prostate cancer pool. Expression was also detected in bladder cancer pool, cancer metastasis pool, and vital pool 2 but not in the vital pool 1.

FIG. 16 shows expression of 74P3B3 in normal tissues. Two multiple tissue northern blots (A and B; Clontech) both with 2 μg of mRNA/lane, and a LAPC xenograft blot with 10 μg of total RNA/lane (C) were probed with the 74P3B3 SSH fragment. Size standards in kilobases (kb) are indicated on the side. Results show expression of approximately 7 kb 74P3B3 transcript in prostate but not in the other normal tissues tested. Expression was also detected in LAPC-4AD and LAPC-4AI but not in LAPC-9AD and LAPC-9AI.

FIG. 17 shows expression of 74P3B3 in prostate cancer patient specimens. RNA was extracted from normal prostate (NP), pool of 3 prostate cancer patient tumors (T) and their normal adjacent tissues (N). Northern blot with 10 mg of total RNA/lane was probed with 74P3B3 SSH sequence. Size standards in kilobases (kb) are indicated on the side. The results show strong expression of 74P3B3 in normal prostate and in patient prostate cancer specimens.

FIG. 18 shows expression of 74P3B3 in patient cancer specimens. Expression of 74P3B3 was assayed in a panel of human cancers (T) and their respective matched normal tissues (N) on RNA dot blots. Upregulated expression of 74P3B3 in tumors compared to normal tissues was observed in prostate, kidney, breast and colon tumors. The expression detected in normal adjacent tissues (isolated from diseased tissues) but not in normal tissues (isolated from healthy donors) may indicate that these tissues are not fully normal and that 74P3B3 may be expressed in early stage tumors.

FIG. 19 shows expression of 83P4B8 by RT-PCR. First strand cDNA was prepared from vital pool 1 (liver, lung and kidney), vital pool 2 (pancreas, colon and stomach), prostate cancer pool, bladder cancer pool, kidney cancer pool, colon cancer pool, lung cancer pool, ovary cancer pool, breast cancer pool, and cancer metastasis pool. Normalization was performed by PCR using primers to actin and GAPDH. Semi-quantitative PCR, using primers to 83P4B8, was performed at 30 cycles of amplification. Results show strong expression of 83P4B8 in all cancer pools tested. Very low expression was detected in the vital pools.

FIG. 20 shows expression of 83P4B8 in normal tissues. Two multiple tissue northern blots (A and B; Clontech) both with 2 μg of mRNA/lane, and a LAPC xenograft blot with 10 μg of total RNA/lane (C) were probed with the 83P4B8 SSH fragment. Size standards in kilobases (kb) are indicated on the side. Results show expression of two approximately 4.4 kb 83P4B8 transcripts in testis and to lower level in thymus but not in the other normal tissues tested. Expression was also detected in all 4 LAPC prostate cancer xenografts.

FIG. 21 shows expression of 83P4B8 in patient cancer specimens and normal tissues. RNA was extracted from a pool of three prostate cancers (PC), bladder cancers (BC), kidney cancers (KC), colon cancers (CC), lung cancers (LC), ovary cancers (OC), cancer metastasis (Met), pancreas cancers (PaC), as well as from normal prostate (NP), normal bladder (NB), normal kidney (NK), normal colon (NC), normal lung (NL), normal breast (NBr) normal ovary (NO) and normal pancreas (NPa). Northern blot with 10 mg of total RNA/lane was probed with 83P4B8 sequence. Size standards in kilobases (kb) are indicated on the side. Results show expression of 83P4B8 in the bladder cancers and ovary cancers. Expression of 83P4B8 was also detected in prostate cancers, kidney cancers, colon cancers, lung cancers, cancer metastasis and pancreas cancer but not in the normal tissues tested.

FIG. 22 shows expression of 83P4B8 in prostate cancer patient specimens. RNA was extracted from normal prostate (NP), prostate cancer patient tumors (T) and their normal adjacent tissues (N). Northern blot with 10 mg of total RNA/lane was probed with 83P4B8 SSH sequence. Size standards in kilobases (kb) are indicated on the side. The results show strong expression of 83P4B8 in the patient prostate cancer specimens.

FIG. 23 shows expression of 83P4B8 in colon cancer patient specimens. RNA was extracted from colon cancer cell lines (CL), normal colon (N), colon cancer patient tumors (T) and their normal adjacent tissues (Nat). Northern blots with 10 μg of total RNA were probed with the 83P4B8 SSH fragment. Size standards in kilobases are indicated on the side. Results show strong expression of 83P4B8 in the colon tumor tissues and in all three colon cancer cell lines tested, but not in the normal tissues.

FIG. 24 shows expression of 109P1D4 by RT-PCR. First strand cDNA was prepared from vital pool 1 (liver, lung and kidney), vital pool 2 (pancreas, colon and stomach), prostate cancer pool, bladder cancer pool, kidney cancer pool, colon cancer pool, lung cancer pool, ovary cancer pool, breast cancer pool, cancer metastasis pool, and pancreas cancer pool. Normalization was performed by PCR using primers to actin and GAPDH. Semi-quantitative PCR, using primers to 109P1D4, was performed at 30 cycles of amplification. Results show strong expression of 109P1D4 in all cancer pools tested. Very low expression was detected in the vital pools FIG. 25 shows expression of 109P1D4 in normal tissues. Two multiple tissue northern blots (Clontech), both with 2 μg of mRNA/lane, were probed with the 109P1D4 SSH fragment. Size standards in kilobases (kb) are indicated on the side. Results show expression of approximately 10 kb 109P1D4 transcript in ovary. Weak expression was also detected in placenta and brain, but not in the other normal tissues tested.

FIG. 26 shows expression of 109P1D4 in human cancer cell lines. RNA was extracted from a number of human prostate and bone cancer cell lines. Northern blots with 10 μg of total RNA/lane were probed with the 109P1D4 SSH fragment. Size standards in kilobases (kb) are indicated on the side. Results show expression of 109P1D4 in LAPC-9AD, LAPC-9AI, LNCaP prostate cancer cell lines, and in the bone cancer cell lines, SK-ES-1 and RD-ES.

FIG. 27 shows expression of 109P1D4 in patient cancer specimens. Expression of 109P1D4 was assayed in a panel of human cancers (T) and their respective matched normal tissues (N) on RNA dot blots. Upregulated expression of 109P1D4 in tumors compared to normal tissues was observed in uterus, lung and stomach. The expression detected in normal adjacent tissues (isolated from diseased tissues) but not in normal tissues (isolated from healthy donors) may indicate that these tissues are not fully normal and that 109P1D4 may be expressed in early stage tumors.

FIG. 28 shows expression of 151P1C7A by RT-PCR. First strand cDNA was prepared from vital pool 1 (liver, lung and kidney), vital pool 2 (pancreas, colon and stomach), LAPC prostate cancer xenograft pool (LAPC-4AD, LAPC-4AI, LAPC-9AD and LAPC-9AI), prostate cancer pool, bladder cancer pool, kidney cancer pool, colon cancer pool, lung cancer pool, and cancer metastasis pool. Normalization was performed by PCR using primers to actin and GAPDH. Semi-quantitative PCR, using primers to 151P1C7A, was performed at 26 and 30 cycles of amplification. Results show strong expression of 151P1C7A in bladder, lung, and metastasis cancer pools tested. Expression was also detected in xenograft, prostate, kidney and colon cancer pools but not in the vital pools.

FIG. 29 shows expression of 151P1C7A in normal tissues. Two multiple tissue northern blots (Clontech), both with 2 μg of mRNA/lane, were probed with the 151P1C7A SSH fragment. Size standards in kilobases (kb) are indicated on the side. Results show expression of an approximately 2 kb 151P1C7A transcript in placenta but not in the other normal tissues tested.

FIG. 30 shows expression of 151P1C7A in bladder cancer patient specimens. RNA was extracted from bladder cancer cell lines (CL; UM-UC-3, J82, SCaBER), normal bladder (Nb), bladder cancer patient tumors (T) and their normal adjacent tissue (N) isolated from bladder cancer patients. Northern blots with 10 μg of total RNA were probed with the 151P1C7A SSH sequence. Size standards in kilobases are indicated on the side. Results show expression of 151P1C7A in patient bladder cancer tissues, and in all bladder cancer cell lines tested, but not in normal bladder.

FIG. 31 shows expression of 151P1C7A in prostate cancer patient specimens. RNA was extracted from normal prostate (NP), prostate cancer patient tumors (T) and their normal adjacent tissues (N). Northern blot with 10 mg of total RNA/lane was probed with 151P1C7A SSH sequence. Size standards in kilobases (kb) are indicated on the side. Results show expression of 151P1C7A in the patient prostate cancer specimens.

FIG. 32 shows expression of 151P4E11 by RT-PCR. First strand cDNA was prepared from vital pool 1 (liver, lung and kidney), vital pool 2 (pancreas, colon and stomach), LAPC prostate cancer xenograft pool (LAPC-4AD, LAPC-4AI, LAPC-9AD and LAPC-9AI), prostate cancer pool, bladder cancer pool, colon cancer pool, lung cancer pool, ovary cancer pool, breast cancer pool, and cancer metastasis pool. Normalization was performed by PCR using primers to actin and GAPDH. Semi-quantitative PCR, using primers to 151P4E11, was performed at 26 and 30 cycles of amplification. Results show strong expression of 151P4E11 in all cancer pools tested. Expression was detected in vital pool 2 but not in vital pool 1.

FIG. 33 shows expression of 151P4E11 in normal tissues. Two multiple tissue northern blots (A and B; Clontech) both with 2 μg of mRNA/lane, and a LAPC xenograft blot with 10 μg of total RNA/lane (C) were probed with the 151P4E11 SSH fragment. Size standards in kilobases (kb) are indicated on the side. Results show expression of an approximately 1.2 kb 151P4E11 transcript in prostate, testis, colon and small intestine. Expression was also detected in all the LAPC prostate cancer xenografts LAPC-4AD, LAPC-4AI, and LAPC-9AI, but not in LAPC-9AD.

FIG. 34 shows expression of 154P2A8 by RT-PCR. First strand cDNA was prepared from vital pool 1 (liver, lung and kidney), vital pool 2 (pancreas, colon and stomach), prostate cancer pool, bladder cancer pool, kidney cancer pool, colon cancer pool, lung cancer pool, and cancer metastasis pool. Normalization was performed by PCR using primers to actin and GAPDH. Semi-quantitative PCR, using primers to 154P2A8, was performed at 26 and 30 cycles of amplification. Results show strong expression of 154P2A8 in bladder cancer pool and lung cancer pool. Expression was also detected in prostate cancer pool, kidney cancer pool, colon cancer pool, and cancer metastasis pool but not in vital pool 1 and vital pool 2.

FIG. 35 shows expression of 156P1D4 by RT-PCR. First strand cDNA was prepared from vital pool 1 (liver, lung and kidney), vital pool 2 (pancreas, colon and stomach), LAPC prostate cancer xenograft pool (LAPC-4AD, LAPC-4AI, LAPC-9AD and LAPC-9AI), prostate cancer pool, bladder cancer pool, kidney cancer pool, colon cancer pool, lung cancer pool, ovary cancer pool, breast cancer pool, and cancer metastasis pool. Normalization was performed by PCR using primers to actin and GAPDH. Semi-quantitative PCR, using primers to 156P1D4, was performed at 26 and 30 cycles of amplification. Results show strong expression of 156P1D4 in kidney cancer pool and vital pool 1. Expression was also detected in xenograft pool, prostate cancer pool, bladder cancer pool, colon cancer pool, lung cancer pool, ovary cancer pool, breast cancer pool, cancer metastasis pool and vital pool 2.

FIG. 36 shows expression of 156P1D4 in normal tissues. Two multiple tissue northern blots (Clontech), both with 2 μg of mRNA/lane, were probed with the 156P1D4 SSH fragment. Size standards in kilobases (kb) are indicated on the side. Results show expression of an approximately 2 kb 156P1D4 transcript in kidney and prostate but not in the other normal tissues tested.

FIG. 37 shows expression of 156P1D4 in kidney cancer patient specimens. RNA was extracted from normal kidney (Nk), kidney cancer patient tumors (T) and their normal adjacent tissues (N). Northern blots with 10 μg of total RNA were probed with the 156P1D4 SSH fragment. Size standards in kilobases are indicated on the side. Results show strong expression of 156P1D4 in all kidney tumor tissues tested. The expression of 156P1D4 detected in tumor tissues is stronger than in normal tissues.

FIG. 38 shows expression of 156P5C12 by RT-PCR. First strand cDNA was prepared from vital pool 1 (liver, lung and kidney), vital pool 2 (pancreas, colon and stomach), LAPC prostate cancer xenograft pool (LAPC-4AD, LAPC-4AI, LAPC-9AD and LAPC-9AI), prostate cancer pool, bladder cancer pool, kidney cancer pool, colon cancer pool, lung cancer pool, ovary cancer pool, breast cancer pool, and cancer metastasis pool. Normalization was performed by PCR using primers to actin and GAPDH. Semi-quantitative PCR, using primers to 156P5C12, was performed at 26 and 30 cycles of amplification. Results show strong expression of 156P5C12 in kidney cancer pool and vital pool 1. Expression was also detected in xenograft pool, prostate cancer pool, bladder cancer pool, colon cancer pool, lung cancer pool, ovary cancer pool, breast cancer pool, cancer metastasis pool and vital pool 2.

FIG. 39 shows expression of 156P5C12 in normal tissues. Two multiple tissue northern blots (Clontech), both with 2 μg of mRNA/lane, were probed with the 156P5C12 SSH fragment. Size standards in kilobases (kb) are indicated on the side. Results show expression of an approximately 1.4 kb 156P5C12 transcript in kidney but not in the other normal tissues tested.

FIG. 40 shows expression of 156P5C12 in kidney cancer patient specimens. RNA was extracted from kidney cancer cell lines (CL; 769-P, A498, SW839), normal kidney (N), kidney cancer patient tumors (T) and their normal adjacent tissues (NAT). Northern blots with 10 μg of total RNA were probed with the 156P5C12 SSH fragment. Size standards in kilobases are indicated on the side. Results show expression of 156P5C12 in normal tissues, and in some but not all kidney tumor tissues. Expression was absent in the kidney cancer cell lines tested.

FIG. 41 shows expression of 159P2B5 by RT-PCR. First strand cDNA was prepared from vital pool 1 (liver, lung and kidney), vital pool 2 (pancreas, colon and stomach), and bladder cancer pool. Normalization was performed by PCR using primers to actin and GAPDH. Semi-quantitative PCR, using primers to 159P2B5, was performed at 26 and 30 cycles of amplification. Results show expression of 159P2B5 in bladder cancer pool tested but not in the vital pools.

FIG. 42 shows expression of 159P2B5 in normal tissues. Two multiple tissue northern blots (Clontech), both with 2 μg of mRNA/lane, were probed with the 159P2B5 SSH fragment. Size standards in kilobases (kb) are indicated on the side. Results show very weak expression of an approximately 4.5 kb159P2B5 transcript in spleen, kidney and small intestine.

FIG. 43 shows expression of 159P2B5 in bladder cancer patient specimens. RNA was extracted from bladder cancer cell lines (CL; UM-UC-3, J82, SCaBER), normal bladder (NB), and bladder cancer patient tumors (T) isolated from bladder cancer patients. Northern blots with 10 μg of total RNA were probed with the 159P2B5 SSH sequence. Size standards in kilobases are indicated on the side. Results show expression of 159P2B5 in patient bladder cancer tissues, and in the SCaBER bladder cancer cell line, but not in normal bladder, nor in the other cancer cell lines tested.

FIG. 44 shows expression of 161P2B7A by RT-PCR. First strand cDNA was prepared from vital pool 1 (liver, lung and kidney), vital pool 2 (pancreas, colon and stomach), prostate metastasis to lymph node (LN), prostate cancer pool, bladder cancer pool, kidney cancer pool, colon cancer pool, lung cancer pool, ovary cancer pool, breast cancer pool, cancer metastasis pool and pancreas cancer pool. Normalization was performed by PCR using primers to actin and GAPDH. Semi-quantitative PCR, using primers to 161P2B7A, was performed at 26 and 30 cycles of amplification. Results show strong expression of 161P2B7A in lung cancer pool and pancreas cancer pool. Expression was also detected in prostate metastasis to LN, prostate cancer pool, bladder cancer pool, kidney cancer pool, colon cancer pool, ovary cancer pool, breast cancer pool, and cancer metastasis pool. Very low expression was observed in vital pool 2 but not in vital pool 1.

FIG. 45 shows expression of 161P2B7A in normal tissues. Two multiple tissue northern blots (Clontech), both with 2 μg of mRNA/lane, were probed with the 161P2B7A SSH fragment. Size standards in kilobases (kb) are indicated on the side. Results show very low expression of 161P2B7A in testis but not in the other normal tissues tested.

FIG. 46 shows expression of 161P2B7A in Multiple Normal Tissues. An mRNA dot blot containing 76 different samples from human tissues was analyzed using a 161P2B7A SSH probe. Expression was not detected in any of the 76 normal tissues tested. The positive genomic DNA control showed very strong signal confirming the validity of the experiment.

FIG. 47 shows expression of 161P2B7A in kidney cancer patient specimens. RNA was extracted from normal kidney (Nk), kidney cancer patient tumors (T) and their normal adjacent tissues (N) isolated from kidney cancer patients. Northern blots with 10 μg of total RNA were probed with the 161P2B7A SSH fragment. Size standards in kilobases are indicated on the side. Results show expression of two 161P2B7A transcripts, approximately 1.2 and 7 kb, in kidney cancer specimens but not in normal kidney.

FIG. 48 shows expression of 161P2B7A in lung cancer patient specimens. RNA was extracted from lung cancer cell lines (CL), normal lung, lung tumors (T), and their normal adjacent tissues (NAT) isolated from lung cancer patients. Northern blot with 10 mg of total RNA/lane was probed with the 161P2B7A fragment. Size standards in kilobases (kb) are indicated on the side. The results show expression of 161P2B7A in the lung tumors, but not in normal lung tissues. Expression was also detected in the lung cancer cell lines CALU-1, A427 and NCI-146 but not in the small cell lung cancer cell line NCI-H82.

FIG. 49 shows expression of 161P2B7A in pancreas and ovary cancer patient specimens. RNA was extracted from normal pancreas (NPa), pancreas cancer (PC), normal ovary (NO), and ovary cancer patient specimen (OC). Northern blot with 10 mg of total RNA/lane was probed with the 161P2B7A fragment. Size standards in kilobases (kb) are indicated on the side. The results show expression of 161P2B7A in the pancreas and ovary cancer patient specimens, but not in the normal tissues.

FIG. 50 shows expression of 179P3G7 by RT-PCR. First strand cDNA was prepared from vital pool 1 (liver, lung and kidney), vital pool 2 (pancreas, colon and stomach), bladder cancer pool, kidney cancer pool, lung cancer pool, breast cancer pool, cancer metastasis pool, pancreas cancer pool and pancreas cancer pool. Normalization was performed by PCR using primers to actin and GAPDH. Semi-quantitative PCR, using primers to 179P3G7, was performed at 26 and 30 cycles of amplification. Results show strong expression of 179P3G7 in kidney cancer pool and breast cancer pool. Expression was also detected in bladder cancer pool, lung cancer pool, cancer metastasis pool, pancreas cancer pool and prostate metastasis to LN, and vital pool 1, but not in vital pool 2.

FIG. 51 shows expression of 179P3G7 in normal tissues. Two multiple tissue northern blots (Clontech), both with 2 μg of mRNA/lane, were probed with the 179P3G7 SSH fragment. Size standards in kilobases (kb) are indicated on the side. Results show expression of 179P3G7 strongly in skeletal muscle, and weakly in kidney, liver and heart but not in the other normal tissues tested.

FIG. 52 shows expression of 179P3G7 in kidney cancer patient specimens. RNA was extracted from normal kidney (Nk), kidney cancer patient tumors (T) and their normal adjacent tissues (N) isolated from kidney cancer patients. Northern blots with 10 μg of total RNA were probed with the 179P3G7 SSH fragment. Size standards in kilobases are indicated on the side. Results show expression of 179P3G7 in kidney cancer specimens. Expression of 179P3G7 is stronger in kidney tumors compared to normal kidney tissues.

FIG. 53 shows expression of 184P3C10B by RT-PCR. First strand cDNA was prepared from vital pool 1 (liver, lung and kidney), vital pool 2 (pancreas, colon and stomach), LAPC prostate cancer xenograft pool (LAPC-4AD, LAPC-4AI, LAPC-9AD and LAPC-9AI), prostate cancer pool, bladder cancer pool, kidney cancer pool, colon cancer pool, lung cancer pool, ovary cancer pool, and cancer metastasis pool. Normalization was performed by PCR using primers to actin and GAPDH. Semi-quantitative PCR, using primers to 184P3C10B, was performed at 26 and 30 cycles of amplification. Results show expression of 184P3C10B in xenograft pool, prostate cancer pool, bladder cancer pool, kidney cancer pool, colon cancer pool, lung cancer pool, ovary cancer pool, and cancer metastasis pool. Expression was also detected in vital pool 2 but at a much lower level in vital pool 1.

FIG. 54 shows expression of 184P3C10B in normal tissues. Two multiple tissue northern blots (Clontech), both with 2 μg of mRNA/lane, were probed with the 184P3C10B SSH fragment. Size standards in kilobases (kb) are indicated on the side. Results show expression of approximately 2.4 and 5 kb 184P3C10B transcripts in placenta and to lower level in colon and small intestine, but not in the other normal tissues tested.

FIG. 55 shows expression of 184P3C10B in bladder cancer patient specimens. RNA was extracted from bladder cancer cell lines (CL; UM-UC-3, J82, SCaBER), normal bladder (Nb), bladder cancer patient tumors (T) and their normal adjacent tissue (N) isolated from bladder cancer patients. Northern blots with 10 μg of total RNA were probed with the 184P3C10B SSH sequence. Size standards in kilobases are indicated on the side. Results show expression of 184P3C10B in patient bladder cancer tissues, and in the bladder cancer cell line SCaBER, but not in normal bladder nor in the other bladder cancer cell lines tested.

FIG. 56 shows expression of 184P3G10 by RT-PCR. First strand cDNA was prepared from vital pool 1 (liver, lung and kidney), vital pool 2 (pancreas, colon and stomach), LAPC prostate cancer xenograft pool (LAPC-4AD, LAPC-4AI, LAPC-9AD and LAPC-9AI), bladder cancer pool, kidney cancer pool, colon cancer pool, and lung cancer pool. Normalization was performed by PCR using primers to actin and GAPDH. Semi-quantitative PCR, using primers to 184P3G10, was performed at 26 and 30 cycles of amplification. Results show strong expression of 184P3G10 in bladder cancer pool, kidney cancer pool, and colon cancer pool. Expression was also detected in xenograft pool, lung cancer pool, vital pool 2 but not in vital pool 1.

FIG. 57 shows expression of 184P3G10 in normal tissues. Two multiple tissue northern blots (Clontech) both with 2 μg of mRNA/lane, were probed with the 184P3G10 SSH fragment. Size standards in kilobases (kb) are indicated on the side. Results show expression of two approximately 4.4 kb 184P3G10 transcripts in colon and small intestine, but not in the other normal tissues tested.

FIG. 58 shows expression of 184P3G10 in patient cancer specimens and normal tissues. RNA was extracted from a pool of three bladder cancers, colon cancers, lung cancers, breast cancers, ovary cancers, cancer metastasis, as well as from normal prostate (NP), normal bladder (NB), and normal kidney (NK). Northern blot with 10 mg of total RNA/lane was probed with 184P3G10 sequence. Size standards in kilobases (kb) are indicated on the side. Results show strong expression of 184P3G10 in the bladder cancers, colon cancers and ovary cancers. Expression of 184P3G10 was also detected in lung cancers, breast cancers, and cancer metastasis but not in the normal tissues tested.

FIG. 59 shows expression of 184P3G10 in bladder cancer patient specimens. RNA was extracted from bladder cancer cell lines (CL; UM-UC-3, J82, SCaBER), normal bladder (N), bladder cancer patient tumors (T) and their normal adjacent tissue (Nat) isolated from bladder cancer patients. Northern blots with 10 μg of total RNA were probed with the 184P3G10 SSH sequence. Size standards in kilobases are indicated on the side. Results show expression of 184P3G10 in patient bladder cancer tissues, but not in normal bladder nor in the bladder cancer cell lines tested.

FIG. 60 shows expression of 185P2C9 by RT-PCR. First strand cDNA was prepared from vital pool 1 (liver, lung and kidney), vital pool 2 (pancreas, colon and stomach), prostate metastasis to lymph node (LN), prostate cancer pool, bladder cancer pool, kidney cancer pool, colon cancer pool, lung cancer pool, ovary cancer pool, breast cancer pool, cancer metastasis pool and pancreas cancer pool. Normalization was performed by PCR using primers to actin and GAPDH. Semi-quantitative PCR, using primers to 185P2C9, was performed at 30 cycles of amplification. Results show strong expression of 185P2C9 in bladder cancer pool, colon cancer pool, lung cancer pool, ovary cancer pool and pancreas cancer pool. Expression was also detected in prostate metastasis to LN, prostate cancer pool, kidney cancer pool, breast cancer pool, cancer metastasis pool, vital pool 2 but not in vital pool 1.

FIG. 61 shows expression of 185P2C9 in normal tissues. Two multiple tissue northern blots (Clontech), both with 2 μg of mRNA/lane, were probed with the 185P2C9 SSH fragment. Size standards in kilobases (kb) are indicated on the side. Results show expression of and approximately 8.5 kb 185P2C9 transcript in testis and brain, but not in the other normal tissues tested.

FIG. 62 shows expression of 185P2C9 in bladder cancer patient specimens. RNA was extracted from bladder cancer cell lines (CL; UM-UC-3, J82, SCaBER), normal bladder (Nb), bladder cancer patient tumors (T) and their normal adjacent tissue (N) isolated from bladder cancer patients. Northern blots with 10 μg of total RNA were probed with the 185P2C9 SSH sequence. Size standards in kilobases are indicated on the side. Results show expression of 185P2C9 in bladder cancer patient tissues, and in the bladder cancer cell lines tested. Expression of 185P2C9 is significantly stronger in bladder tumor tissues compared to normal tissues.

FIG. 63 shows expression of 185P2C9 in kidney cancer patient specimens. RNA was extracted from kidney cancer cell lines (CL; 769-P, A498, Caki-1), normal kidney (N), kidney cancer patient tumors (T) and their normal adjacent tissues (NAT) isolated from kidney cancer patients. Northern blots with 10 μg of total RNA were probed with the 185P2C9 SSH fragment. Size standards in kilobases are indicated on the side. Results show expression of 185P2C9 in kidney cancer specimens and kidney cancer cell lines, but not in normal kidney.

FIG. 64 shows expression of 186P1H9 by RT-PCR. First strand cDNA was prepared from vital pool 1 (liver, lung and kidney), vital pool 2 (pancreas, colon and stomach), bladder cancer pool, kidney cancer pool, colon cancer pool, lung cancer pool, ovary cancer pool, cancer metastasis pool, and pancreas cancer pool. Normalization was performed by PCR using primers to actin and GAPDH. Semi-quantitative PCR, using primers to 186P1H9, was performed at 26 and 30 cycles of amplification. Results show strong expression of 186P1H9 in kidney cancer pool, colon cancer pool, ovary cancer pool, cancer metastasis pool, and pancreas cancer pool. Expression was also detected in bladder cancer pool, lung cancer pool, and vital pool 2 but not in vital pool 1.

FIG. 65 shows expression of 186P1H9 in normal tissues. Two multiple tissue northern blots (Clontech) both with 2 μg of mRNA/lane, were probed with the 186P1H9 SSH fragment. Size standards in kilobases (kb) are indicated on the side. Results show expression of an approximately 2.6 kb 186P1H9 transcript in testis, spleen, pancreas and brain. Lower expression is also detected in heart, skeletal muscle, prostate, colon and small intestine.

FIG. 66 shows expression of 186P1H9 in patient cancer specimens and normal tissues. RNA was extracted from a pool of three kidney cancers (KC), ovary cancers (OC), cancer metastasis (Met), pancreas cancers (PaC), as well as from normal prostate (NP), normal bladder (NB), and normal kidney (NK), normal colon (NC), normal lung (NL), normal breast (NBr), normal ovary (NO), and normal pancreas (NPa). Northern blot with 10 mg of total RNA/lane was probed with 186P1H9 sequence. Size standards in kilobases (kb) are indicated on the side. Results show strong expression of 186P1H9 in the bladder cancers, ovary cancers, cancer metastasis and pancreas cancers, but not in normal tissues. Expression of 186P1H9 is significantly stronger in patient cancer tissues compared to normal tissues.

FIG. 67 shows expression of 186P1H9 in kidney cancer patient specimens. RNA was extracted from kidney cancer cell lines (CL; 769-P, A498, Caki-1), normal kidney (N), kidney cancer patient tumors (T) and their normal adjacent tissues (NAT) isolated from kidney cancer patients. Northern blots with 10 μg of total RNA were probed with the 186P1H9 SSH fragment. Size standards in kilobases are indicated on the side. Results show strong expression of 186P1H9 in kidney cancer patient specimens, but not in normal kidney, nor in the kidney cancer cell lines.

FIG. 68 shows expression of 186P1H9 in ovarian and testicular cancer patient specimens. RNA was extracted from normal ovary (NO), ovary cancer patient specimens (P1, P2, P3), normal testis (NTe), and testis cancer patient specimens (P4, P5, P6). Northern blot with 10 mg of total RNA/lane was probed with the 186P1H9 SSH fragment. Size standards in kilobases (kb) are indicated on the side. The results show strong expression of 186P1H9 in the ovary cancer patient specimens, but not in the normal ovary. Expression was also detected in normal and in testis cancer specimens.

FIG. 69 shows expression of 187P3F2 by RT-PCR. First strand cDNA was prepared from vital pool 1 (liver, lung and kidney), vital pool 2 (pancreas, colon and stomach), kidney cancer pool, and pancreas cancer pool. Normalization was performed by PCR using primers to actin and GAPDH. Semi-quantitative PCR, using primers to 187P3F2, was performed at 26 and 30 cycles of amplification. Results show strong expression of 187P3F2 in kidney cancer pool, pancreas cancer pool and vital pool 1, but not in vital pool 2.

FIG. 70 shows expression of 187P3F2 in normal tissues. Two multiple tissue northern blots (Clontech) both with 2 μg of mRNA/lane, were probed with the 187P3F2 SSH fragment. Size standards in kilobases (kb) are indicated on the side. Results show expression of a 4.5 kb 187P3F2 transcript in kidney and brain, but not in the other tissues tested.

FIG. 71 shows expression of 187P3F2 in patient cancer specimens and normal tissues. RNA was extracted from a pool of three kidney cancers (KC), pancreas cancers (PaC), as well as from normal prostate (NP), normal bladder (NB), and normal kidney (NK), normal colon (NC), normal lung (NL), normal breast (NBr), normal ovary (NO), and normal pancreas (NPa). Northern blot with 10 mg of total RNA/lane was probed with 187P3F2 sequence. Size standards in kilobases (kb) are indicated on the side. Results show strong expression of 187P3F2 in kidney cancers, pancreas cancers, and normal kidney, but not in the other normal tissues.

FIG. 72 shows expression of 187P3F2 in pancreas cancer patient specimens. RNA was extracted from pancreas cancer cell lines (CL), normal pancreas (N), and pancreas tumor tissues (T) isolated from pancreatic cancer patients. Northern blot with 10 mg of total RNA/lane was probed with the 187P3F2 SSH fragment. Size standards in kilobases (kb) are indicated on the side. The results show strong expression of 187P3F2 in the pancreas cancer specimens, but not in normal pancreas nor in the cancer cell lines tested.

FIG. 73 shows expression of 192P2G7 by RT-PCR. First strand cDNA was prepared from vital pool 1 (liver, lung and kidney), vital pool 2 (pancreas, colon and stomach), prostate cancer pool, bladder cancer pool, kidney cancer pool, lung cancer pool, ovary cancer pool, breast cancer pool, cancer metastasis pool, pancreas cancer pool, and prostate metastasis to lymph node (LN). Normalization was performed by PCR using primers to actin and GAPDH. Semi-quantitative PCR, using primers to 186P1H9, was performed at 26 and 30 cycles of amplification. Results show strong expression of 186P1H9 in pancreas cancer pool and prostate metastasis to LN. Expression was also detected in prostate cancer pool, bladder cancer pool, kidney cancer pool, lung cancer pool, ovary cancer pool, breast cancer pool, cancer metastasis pool, vital pool 2 but not in vital pool 1.

FIG. 74 shows expression of 185P3C2 by RT-PCR. First strand cDNA was prepared from vital pool 1 (liver, lung and kidney), vital pool 2 (pancreas, colon and stomach), and bladder cancer pool. Normalization was performed by PCR using primers to actin and GAPDH. Semi-quantitative PCR, using primers to 185P3C2, was performed at 26 and 30 cycles of amplification. Results show strong expression of 185P3C2 in bladder cancer pool. Low level expression was detected in vital pool 2, but not in vital pool 1.

Example 5

Transcript Variants of Genes of the Invention

Transcript variants are variants of matured mRNA from the same gene by alternative transcription or alternative splicing. Alternative transcripts are transcripts from the same gene but start transcription at different points. Splice variants are mRNA variants spliced differently from the same transcript. In eukaryotes, when a multi-exon gene is transcribed from genomic DNA, the initial RNA is spliced to produce functional mRNA, which has only exons and is used for translation into an amino acid sequence. Accordingly, a given gene can have zero to many alternative transcripts and each transcript can have zero to many splice variants. Each transcript variant has a unique exon makeup, and can have different coding and/or non-coding (5' or 3' end) portions, from the original transcript. Transcript variants can code for similar or different proteins with the same or a similar function or may encode proteins with different functions, and may be expressed in the same tissue at the same time, or at different tissue, or at different times, proteins encoded by transcript variants can have similar or different cellular or extracellular localizations, i.e., be secreted.

Transcript variants are identified by a variety of art-accepted methods. For example, alternative transcripts and splice variants are identified full-length cloning experiment, or by use of full-length transcript and EST sequences. First, all human ESTs were grouped into clusters which show direct or indirect identity with each other. Second, ESTs in the same cluster were further grouped into sub-clusters and assembled into a consensus sequence. The original gene sequence is compared to the consensus sequence(s) or other full-length sequences. Each consensus sequence is a potential splice variant for that gene. Even when a variant is identified that is not a full-length clone, that portion of the variant is very useful for antigen generation and for further cloning of the full-length splice variant, using techniques known in the art.

Moreover, computer programs available in the art are used that identify transcript variants based on genomic sequences. Genomic-based transcript variant identification programs include FgenesH (A. Salamov and V. Solovyev, "Ab initio gene finding in *Drosophila* genomic DNA," Genome Research. 2000 April; 10(4): 516-22). For a general discussion of splice variant identification protocols see., e.g., Southan, C., A genomic perspective on human proteases, FEBS Lett. 2001 Jun. 8; 498(2-3):214-8; de Souza, S. J., et al., Identification of human chromosome 22 transcribed sequences with ORF expressed sequence tags, Proc. Natl. Acad Sci USA. 2000 Nov. 7; 97(23): 12690-3.

To further confirm the parameters of a transcript variant, a variety of techniques available in the art are used, such as full-length cloning, proteomic validation, PCR-based validation, and 5' RACE validation, etc. (see e.g., Proteomic Validation: Brennan, S. O., et al., Albumin banks peninsula: a new termination variant characterized by electrospray mass spectrometry, Biochem Biophys Acta. 1999 Aug. 17; 1433(1-2): 321-6; Ferranti P, et al., Differential splicing of pre-messenger RNA produces multiple forms of mature caprine alpha (s1)-casein, Eur J. Biochem. 1997 Oct. 1; 249(1):1-7. For PCR-based Validation: Wellmann S, et al., Specific reverse transcription-PCR quantification of vascular endothelial growth factor (VEGF) splice variants by LightCycler technology, Clin Chem. 2001 April; 47(4):654-60; Jia, H. P., et al., Discovery of new human beta-defensins using a genomics-based approach, Gene. 2001 Jan. 24; 263(1-2):211-8. For PCR-based and 5' RACE Validation: Brigle, K. E., et al., Organization of the murine reduced folate carrier gene and identification of variant splice forms, Biochem Biophys Acta. 1997 Aug. 7; 1353(2): 191-8).

It is known in the art that genomic regions are modulated in cancers. When the genomic region to which a gene maps is modulated in a particular cancer, the alternative transcripts or splice variants of the gene are modulated as well. Disclosed herein is a particular expression profile of the target genes related to cancer. Alternative transcripts and splice variants of these genes may also be involved in cancers in the same or different tissues, thus serving as tumor-associated markers/antigens.

Using the full-length gene and EST sequences, five transcript variants were identified for 83P4B8, seven for 109P1D4, one for 151P4E11, two for 161P2B7A, one for 179P3G7, four for 184P3G10, two for 185P2C9, four for 185P3C2, and two for 192P2G7, as displayed in FIGS. 11-14.

FIG. 11 through FIG. 14 are set forth herein on a gene-by-gene basis. The following list shows the numbering of figures and the corresponding genes. nucleotide sequence of a transcript variant. FIG. 11 displays the nucleotide sequences of transcript variants. FIG. 12 shows amino acid sequences of proteins translated from the corresponding transcript variants. FIG. 13 displays the alignment of nucleotide sequences of transcript variants. FIG. 14 displays the alignment of protein sequences from the corresponding transcript variants.

Number of Transcript Variants for Target Genes and the Numbering of Associated Figures.

| Target Gene | Number of Trans. Var. | FIG. Number |
|---|---|---|
| 83P4B8 | 5 | FIG. 11b-14b |
| 109P1D4 | 7 | FIG. 11c-14c |

-continued

| Target Gene | Number of Trans. Var. | FIG. Number |
|---|---|---|
| 151P4E11 | 1 | FIG. 11e–14e |
| 161P2B7A | 2 | FIG. 11j–14j |
| 179P3G7 | 1 | FIG. 11k–14k |
| 184P3G10 | 4 | FIG. 11m–14m |
| 185P2C9 | 2 | FIG. 11n–14n |
| 185P3C2 | 4 | FIG. 11o–14o |
| 192P2G7 | 2 | FIG. 11r–14r |

Example 6

Production of Recombinant Targets of the Invention in Prokaryotic Systems

To express a recombinant gene of FIG. 2 in prokaryotic cells, full or partial length gene cDNA sequences are cloned into any one of a variety of expression vectors known in the art. One or more of the following regions of genes set forth in FIG. 2, or variants or analogs thereof, are expressed in these constructs: regions that encode the entire, respective, amino acid sequence of a particular target, or any 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more contiguous amino acids from a protein of FIG. 2, variants, or analogs thereof.

A. In Vitro Transcription and Translation Constructs:

pCRII: To generate sense and anti-sense RNA probes for RNA in situ investigations, pCRII constructs (Invitrogen, Carlsbad Calif.) are generated encoding either all of or fragments of a cDNA. The pCRII vector has Sp6 and T7 promoters flanking the insert to drive the transcription of RNA for use as probes in RNA in situ hybridization experiments. These probes are used to analyze the cell and tissue expression of a gene at the RNA level. Transcribed RNA representing the cDNA amino acid coding region of the gene is used in in vitro translation systems such as the TnT™ Coupled Reticulolysate System (Promega, Corp., Madison, Wis.) to synthesize a protein of the invention.

B. Bacterial Constructs:

pGEX Constructs: To generate recombinant proteins of the invention in bacteria that are fused to the Glutathione S-transferase (GST) protein, all of or parts of a cDNA protein coding sequence of the invention are fused to the GST gene by cloning into pGEX-6P-1 or any other GST-fusion vector of the pGEX family (Amersham Pharmacia Biotech, Piscataway, N.J.). These constructs allow controlled expression of recombinant target of the invention protein sequences with GST fused at the amino-terminus and a six histidine epitope (6×His) at the carboxyl-terminus. The GST and 6×His tags permit purification of the recombinant fusion protein from induced bacteria with the appropriate affinity matrix and allow recognition of the fusion protein with anti-GST and anti-His antibodies. The 6×His tag is generated by adding 6 histidine codons to the cloning primer at the 3' end, e.g., of the open reading frame (ORF). A proteolytic cleavage site, such as the PreScission™ recognition site in pGEX-6P-1, can be employed to permit cleavage of the GST tag from target of the invention-related protein. The ampicillin resistance gene and pBR322 origin permits selection and maintenance of the pGEX plasmids in *E. coli.* pMAL Constructs: To generate, in bacteria, recombinant target of the invention proteins that are fused to maltose-binding protein (MBP), all of or parts of the target of the invention cDNA protein coding sequence are fused to the MBP gene by cloning into the pMAL-c2X and pMAL-p2X vectors (New England Biolabs, Beverly, Mass.). These constructs allow controlled expression of recombinant target of the invention protein sequences with MBP fused at the amino-terminus and a 6×His epitope tag at the carboxyl-terminus. The MBP and 6×His tags permit purification of the recombinant protein from induced bacteria with the appropriate affinity matrix and allow recognition of the fusion protein with anti-MBP and anti-His antibodies. The 6×His epitope tag is generated by adding 6 histidine codons to the 3' cloning primer. A Factor Xa recognition site permits cleavage of the pMAL tag from a target of the invention. The pMAL-c2X and pMAL-p2X vectors are optimized to express the recombinant protein in the cytoplasm or periplasm respectively. Periplasm expression enhances folding of proteins with disulfide bonds.

pET Constructs: To express a target of the invention in bacterial cells, all of or parts of the target of the invention cDNA protein coding sequence are cloned into the pET family of vectors (Novagen, Madison, Wis.). These vectors allow tightly controlled expression of recombinant target of the invention protein in bacteria with and without fusion to proteins that enhance solubility, such as NusA and thioredoxin (Trx), and epitope tags, such as 6×His and S-Tag™ that aid purification and detection of the recombinant protein. For example, constructs are made utilizing pET NusA fusion system 43.1 such that regions of the target of the invention protein are expressed as amino-terminal fusions to NusA. In one embodiment, a NusA-fusion protein encompassing certain amino acids of a FIG. 2 protein with a C-terminal 6×His tag are expressed in *E. coli*, purified by metal chelate affinity chromatography, and used as an immunogen for generation of antibodies.

C. Yeast Constructs:

pESC Constructs: To express a target of the invention in the yeast species *Saccharomyces cerevisiae* for generation of recombinant protein and functional studies, all of or parts of a target of the invention cDNA protein coding sequence are cloned into the pESC family of vectors each of which contain 1 of 4 selectable markers, HIS3, TRP1, LEU2, and URA3 (Stratagene, La Jolla, Calif.). These vectors allow controlled expression from the same plasmid of up to 2 different genes or cloned sequences containing either Flag™ or Myc epitope tags in the same yeast cell. This system is useful to confirm protein-protein interactions of a target of the invention. In addition, expression in yeast yields similar post-translational modifications, such as glycosylations and phosphorylations, that are found when expressed in eukaryotic cells.

pESP Constructs: To express a target of the invention in the yeast species *Saccharomyces pombe*, all of or parts of a target of the invention cDNA protein coding sequence are cloned into the pESP family of vectors. These vectors allow controlled high level of expression of a target of the invention protein sequence that is fused at either the amino terminus or at the carboxyl terminus to GST which aids purification of the recombinant protein. A Flag™ epitope tag allows detection of the recombinant protein with anti-Flag™ antibody.

Example 7

Production of Recombinant Target of the Invention in Eukaryotic Systems

A. Mammalian Constructs:

To express a recombinant target of the invention in eukaryotic cells, the full or partial length target of the invention cDNA sequences can be cloned into any one of a variety of expression vectors known in the art. One or more of the following peptide regions of a protein of the invention are expressed in these constructs: any 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more contiguous amino acids from a protein of FIG. 2, variants, or analogs thereof. In certain embodiments a region of a specific variant of a target of the invention is expressed that encodes an amino acid at a specific position which differs from the amino acid of any other respective variant found at that position. In other embodiments, a region of a variant of the invention is expressed that lies partly or entirely within a sequence that is unique to that variant respective to other variants of that target.

The constructs can be transfected into any one of a wide variety of mammalian cells such as 293T cells. Transfected 293T cell lysates can be probed with the anti-target of the invention polyclonal serum, described herein.

pcDNA4/HisMax Constructs: To express a target of the invention in mammalian cells, a target of the invention ORF, or portions thereof, are cloned into pcDNA4/HisMax Version A (Invitrogen, Carlsbad, Calif.). Protein expression is driven from the cytomegalovirus (CMV) promoter and the SP16 translational enhancer. The recombinant protein has Xpress™ and six histidine (6×His) epitopes fused to the amino-terminus. The pcDNA4/HisMax vector also contains the bovine growth hormone (BGH) polyadenylation signal and transcription termination sequence to enhance mRNA stability along with the SV40 origin for episomal replication and simple vector rescue in cell lines expressing the large T antigen. The Zeocin resistance gene allows for selection of mammalian cells expressing the protein and the ampicillin resistance gene and ColE1 origin permits selection and maintenance of the plasmid in *E. coli.* pcDNA3.1/MycHis Constructs: To express a target of the invention in mammalian cells, a target of the invention ORF, or portions thereof, with a consensus Kozak translation initiation site are cloned into pcDNA3.1/MycHis Version A (Invitrogen, Carlsbad, Calif.). Protein expression is driven from the cytomegalovirus (CMV) promoter. The recombinant proteins have the myc epitope and 6×His epitope fused to the carboxyl-terminus. The pcDNA3.1/MycHis vector also contains the bovine growth hormone (BGH) polyadenylation signal and transcription termination sequence to enhance mRNA stability, along with the SV40 origin for episomal replication and simple vector rescue in cell lines expressing the large T antigen. The Neomycin resistance gene can be used, as it allows for selection of mammalian cells expressing the protein and the ampicillin resistance gene and ColE1 origin permits selection and maintenance of the plasmid in *E. coli.* pcDNA3.1/CT-GFP-TOPO Construct: To express a target of the invention in mammalian cells and to allow detection of the recombinant proteins using fluorescence, a target of the invention ORF, or portions thereof, with a consensus Kozak translation initiation site are cloned into pcDNA3.1/CT-GFP-TOPO (Invitrogen, CA). Protein expression is driven from the cytomegalovirus (CMV) promoter. The recombinant proteins have the Green Fluorescent Protein (GFP) fused to the carboxyl-terminus facilitating non-invasive, in vivo detection and cell biology studies. The pcDNA3.1CT-GFP-TOPO vector also contains the bovine growth hormone (BGH) polyadenylation signal and transcription termination sequence to enhance mRNA stability along with the SV40 origin for episomal replication and simple vector rescue in cell lines expressing the large T antigen. The Neomycin resistance gene allows for selection of mammalian cells that express the protein, and the ampicillin resistance gene and ColE1 origin permits selection and maintenance of the plasmid in *E. coli*. Additional constructs with an amino-terminal GFP fusion are made in pcDNA3.1/NT-GFP-TOPO spanning the entire length of a target of the invention protein.

PAPtag: A target of the invention ORF, or portions thereof, is cloned into pAPtag-5 (GenHunter Corp. Nashville, Tenn.). This construct generates an alkaline phosphatase fusion at the carboxyl-terminus of a target of the invention protein while fusing the IgGκ signal sequence to the amino-terminus. Constructs are also generated in which alkaline phosphatase with an amino-terminal IgGκ signal sequence is fused to the amino-terminus of a target of the invention protein. The resulting recombinant target of the invention proteins are optimized for secretion into the media of transfected mammalian cells and can be used to identify proteins such as ligands or receptors that interact with a target of the invention protein. Protein expression is driven from the CMV promoter and the recombinant proteins also contain myc and 6×His epitopes fused at the carboxyl-terminus that facilitates detection and purification. The Zeocin resistance gene present in the vector allows for selection of mammalian cells expressing the recombinant protein and the ampicillin resistance gene permits selection of the plasmid in *E. coli.* ptag5: A target of the invention ORF, or portions thereof, is cloned into pTag-5. This vector is similar to pAPtag but without the alkaline phosphatase fusion. This construct generates a target of the invention protein with an amino-terminal IgGκ signal sequence and myc and 6×His epitope tags at the carboxyl-terminus that facilitate detection and affinity purification. The resulting recombinant target of the invention protein is optimized for secretion into the media of transfected mammalian cells, and is used as immunogen or ligand to identify proteins such as ligands or receptors that interact with target of the invention proteins. Protein expression is driven from the CMV promoter. The Zeocin resistance gene present in the vector allows for selection of mammalian cells expressing the protein, and the ampicillin resistance gene permits selection of the plasmid in *E. coli.*

PsecFc: A target of the invention ORF, or portions thereof, is also cloned into psecFc. The psecFc vector was assembled by cloning the human immunoglobulin G1 (IgG) Fc (hinge, CH2, CH3 regions) into pSecTag2 (Invitrogen, California). This construct generates an IgG1 Fc fusion at the carboxyl-terminus of a target of the invention protein, while fusing the IgGK signal sequence to N-terminus. Target of the invention fusions utilizing the murine IgG1 Fc region are also used. The resulting recombinant target of the invention proteins are optimized for secretion into the media of transfected mammalian cells, and can be used as immunogens or to identify proteins such as ligands or receptors that interact with a target of the invention protein. Protein expression is driven from the CMV promoter. The hygromycin resistance gene present in the vector allows for selection of mammalian cells that express the recombinant protein, and the ampicillin resistance gene permits selection of the plasmid in *E. coli.* pSRα Constructs: To generate mammalian cell lines that express a target of the invention constitutively, a target of the invention ORF, or portions thereof, are cloned into pSRα constructs. Amphotropic and ecotropic retroviruses are generated by transfection of pSRα constructs into the 293T-10A1 packaging line or co-transfection of pSRα and a helper plasmid (containing deleted packaging sequences) into the 293 cells, respectively. The retrovirus is used to infect a variety of mammalian cell lines, resulting in the integration of the cloned gene, a target of the invention, into the host cell-lines.

Protein expression is driven from a long terminal repeat (LTR). The Neomycin resistance gene present in the vector allows for selection of mammalian cells that express the protein, and the ampicillin resistance gene and ColE1 origin permit selection and maintenance of the plasmid in *E. coli*. The retroviral vectors can thereafter be used for infection and generation of various cell lines using, for example, PC3, NIH 3T3, TsuPr1, 293 or rat-1 cells.

Additional pSRα constructs are made that fuse an epitope tag such as the FLAG™ tag to the carboxyl-terminus of a target of the invention sequence to allow detection using anti-Flag antibodies. For example, the FLAG™ sequence 5' gat tac aag gat gac gac gat aag 3' (SEQ ID NO: 188) is added to cloning primer at the 3' end of the ORF. Additional pSRα constructs are made to produce both amino-terminal and carboxyl-terminal GFP and myc/6×His fusion proteins of the full-length target of the invention proteins.

Additional Viral Vectors: Additional constructs are made for viral-mediated delivery and expression of a target of the invention. High virus titer leading to high level expression of a target of the invention is achieved in viral delivery systems such as adenoviral vectors and herpes amplicon vectors. A target of the invention coding sequence or fragments thereof is amplified by PCR and subcloned into the AdEasy shuttle vector (Stratagene). Recombination and virus packaging are performed according to the manufacturer's instructions to generate adenoviral vectors. Alternatively, target of the invention coding sequences or fragments thereof are cloned into the HSV-1 vector (Imgenex) to generate herpes viral vectors. The viral vectors are thereafter used for infection of various cell lines such as PC3, NIH 3T3, 293 or rat-1 cells.

Regulated Expression Systems: To control expression of a target of the invention in mammalian cells, coding sequences of a target of the invention, or portions thereof, are cloned into regulated mammalian expression systems such as the T-Rex System (Invitrogen), the GeneSwitch System (Invitrogen) and the tightly-regulated Ecdysone System (Sratagene). These systems allow the study of the temporal and concentration dependent effects of recombinant targets of the invention. These vectors are thereafter used to control expression of a target of the invention in various cell lines such as PC3, NIH 3T3, 293 or rat-1 cells.

B. Baculovirus Expression Systems

To generate recombinant target of the invention proteins in a baculovirus expression system, a target of the invention ORF, or portions thereof, are cloned into the baculovirus transfer vector pBlueBac 4.5 (Invitrogen), which provides a His-tag at the N-terminus. Specifically, pBlueBac-target of the invention nucleic acid sequence is co-transfected with helper plasmid pBac-N-Blue (Invitrogen) into SF9 (*Spodoptera frugiperda*) insect cells to generate recombinant baculovirus (see Invitrogen instruction manual for details). Baculovirus is then collected from cell supernatant and purified by plaque assay.

Recombinant target of the invention protein is then generated by infection of HighFive insect cells (Invitrogen) with purified baculovirus. Recombinant target of the invention protein can be detected using anti-target of the invention or anti-His-tag antibody. Target of the invention protein can be purified and used in various cell-based assays or as immunogen to generate polyclonal and monoclonal antibodies specific for a target of the invention.

Example 8

Antigenicity Profiles and Secondary Structure

FIG. 5, FIG. 6, FIG. 7, FIG. 8, and FIG. 9 depict graphically five amino acid profiles of the target of the invention amino acid sequences.

These profiles: FIG. 5, Hydrophilicity, (Hopp T. P., Woods K. R., 1981. Proc. Natl. Acad. Sci. U.S.A. 78:3824-3828); FIG. 6, Hydropathicity, (Kyte J., Doolittle R. F., 1982. J. Mol. Biol. 157:105-132); FIG. 7, Percentage Accessible Residues (Janin J., 1979 Nature 277:491-492); FIG. 8, Average Flexibility, (Bhaskaran R., and Ponnuswamy P. K., 1988. Int. J. Pept. Protein Res. 32:242-255); FIG. 9, Beta-turn (Deleage, G., Roux B. 1987 Protein Engineering 1:289-294); and optionally others available in the art, such as on the ProtScale website, were used to identify antigenic regions of the target of the invention proteins. Each of the above amino acid profiles were generated using the following ProtScale parameters for analysis: 1) A window size of 9; 2) 100% weight of the window edges compared to the window center; and, 3) amino acid profile values normalized to lie between 0 and 1.

Hydrophilicity (FIG. 5), Hydropathicity (FIG. 6) and Percentage Accessible Residues (FIG. 7) profiles were used to determine stretches of hydrophilic amino acids (i.e., values greater than 0.5 on the Hydrophilicity and Percentage Accessible Residues profile, and values less than 0.5 on the Hydropathicity profile). Such regions are likely to be exposed to the aqueous environment, be present on the surface of the protein, and thus be available for immune recognition, such as by antibodies.

Average Flexibility (FIG. 8) and Beta-turn (FIG. 9) profiles determine stretches of amino acids (i.e., values greater than 0.5 on the Beta-turn profile and the Average Flexibility profile) that are not constrained in secondary structures such as beta sheets and alpha helices. Such regions are also more likely to be exposed on the protein and thus accessible for immune recognition, such as by antibodies.

Antigenic sequences of the target of the invention proteins indicated, e.g., by the profiles set forth in FIG. 5, FIG. 6, FIG. 7, FIG. 8, and/or FIG. 9 are used to prepare immunogens, either peptides or nucleic acids that encode them, to generate therapeutic and diagnostic anti-target of the invention antibodies. The immunogen can be any 5, 6, 7, 8, 9, 10, 11, 12, 13, 14, 15, 16, 17, 18, 19, 20, 21, 22, 23, 24, 25, 30, 35, 40, 45, 50 or more than 50 contiguous amino acids, or the corresponding nucleic acids that encode them, from the target of the invention variant proteins. In particular, peptide immunogens for target of the invention proteins can comprise, a peptide region of at least 5 amino acids of a protein of the invention in any whole number increment up to an entire protein that includes an amino acid position having a value greater than 0.5 in the Hydrophilicity profile of FIG. 5; a peptide region of at least 5 amino acids of a protein of the invention in any whole number increment up to the entire protein that includes an amino acid position having a value less than 0.5 in the Hydropathicity profile of FIG. 6; a peptide region of at least 5 amino acids of a protein of the invention in any whole number increment up to the entire protein that includes an amino acid position having a value greater than 0.5 in the Percent Accessible Residues profile of FIG. 7; a peptide region of at least 5 amino acids of a protein of the invention in any whole number increment up to the entire protein that includes an amino acid position having a value greater than 0.5 in the Average Flexibility profile on FIG. 8; and, a peptide region of at least 5 amino acids of a protein of the invention in any whole number increment up to the entire protein that includes an amino acid position having a value greater than 0.5 in the Beta-turn profile of FIG. 9.

All immunogens of the invention, whether peptides or nucleic acids, can be embodied in human unit dose form, or comprised by a composition that includes a pharmaceutical excipient compatible with human physiology.

The secondary structure of a protein of the invention, namely the predicted presence and location of alpha helices, extended strands, and random coils, is predicted from the primary amino acid sequence using the HNN—Hierarchical Neural Network method. The analysis provides the data set forth in FIG. 10 on a protein by protein basis.

Analysis for the presence of transmembrane domains in a protein of the invention was carried out using a variety of transmembrane prediction algorithms. The programs provide the data summarized in Table XXI on a protein by protein basis.

Example 9

Generation of Polyclonal Antibodies of the Invention

Polyclonal antibodies can be raised in a mammal, for example, by one or more injections of an immunizing agent (e.g., a protein of the invention) and, if desired, an adjuvant. Typically, the immunizing agent and/or adjuvant will be injected in the mammal by multiple subcutaneous or intraperitoneal injections. In addition to immunizing with a full length protein of the invention such as that set forth in FIG. 2, computer algorithms are employed in design of immunogens that, based on amino acid sequence analysis contain characteristics of being antigenic and available for recognition by the immune system of the immunized host (see the Example entitled "Antigenicity Profiles"). Such regions would be predicted to be hydrophilic, flexible, in beta-turn conformations, and/or be exposed on the surface of the protein (see, e.g., FIG. 5, FIG. 6, FIG. 7, FIG. 8, and FIG. 9 for amino acid profiles that indicate such regions of a protein of the invention).

For example, of FIG. 2 recombinant bacterial fusion proteins or peptides containing hydrophilic, flexible, beta-turn regions, generally found in regions between transmembrane domains and at the amino and carboxyl termini, are used as antigens to generate polyclonal antibodies in New Zealand White rabbits. Examples of such regions can be extracellular or intracellular. In addition, the amino-terminal region of a variant that is not present in a respective variant can be used as an immunogen. Antibodies to such regions are useful to distinguish one variant protein from another variant of that target. It is useful to conjugate the immunizing agent to a protein known to be immunogenic in the mammal being immunized. Examples of such immunogenic proteins include, but are not limited to, keyhole limpet hemocyanin (KLH), serum albumin, bovine thyroglobulin, and soybean trypsin inhibitor. In one embodiment, a peptide encoding amino acids from a protein of the invention is conjugated to KLH and used to immunize the rabbit. Alternatively the immunizing agent can include all or portions of the of a protein of the invention e.g. in FIG. 2, analogs or fusion proteins thereof. For example, a FIG. 2 amino acid sequence can be fused using recombinant DNA techniques to any one of a variety of fusion protein partners that are well known in the art, such as glutathione-5-transferase (GST) and HIS tagged fusion proteins. Such fusion proteins are purified from induced bacteria using the appropriate affinity matrix.

In one embodiment, a GST-fusion protein encoding amino acids of a protein of the invention is produced and purified and used as immunogen. Other recombinant bacterial fusion proteins that can be employed include maltose binding protein, LacZ, thioredoxin, NusA, or an immunoglobulin constant region (see the Example entitled "Production of Recombinant Targets of the Invention in Prokaryotic Systems" and Current Protocols In Molecular Biology, Volume 2, Unit 16, Frederick M. Ausubul et al. eds., 1995; Linsley, P. S., Brady, W., Urnes, M., Grosmaire, L., Damle, N., and Ledbetter, L. (1991) J. Exp. Med. 174, 561-566).

In addition to bacterial derived fusion proteins, mammalian expressed protein antigens are also used. These antigens are expressed from mammalian expression vectors such as the Tag5 and Fc-fusion vectors (see the Example entitled "Production of Recombinant Targets of the Invention in Eukaryotic Systems"), and retain post-translational modifications such as glycosylations found in native protein. In one embodiment, amino acids from a protein of the invention are cloned into the Tag5 mammalian secretion vector. The recombinant protein is purified by metal chelate chromatography from tissue culture supernatants of 293T cells stably expressing the recombinant vector. The purified Tag5-produced protein of the invention is then used as immunogen.

During the immunization protocol, it is useful to mix or emulsify the antigen in adjuvants that enhance the immune response of the host animal. Examples of adjuvants include, but are not limited to, complete Freund's adjuvant (CFA) and MPL-TDM adjuvant (monophosphoryl Lipid A, synthetic trehalose dicorynomycolate).

In a typical protocol, rabbits are initially immunized subcutaneously with up to 200 μg, typically 100-200 μg, of fusion protein or peptide conjugated to KLH mixed in complete Freund's adjuvant (CFA). Rabbits are then injected subcutaneously every two weeks with up to 200 μg, typically 100-200 μg, of the immunogen in incomplete Freund's adjuvant (IFA). Test bleeds are taken approximately 7-10 days following each immunization and used to monitor the titer of the antiserum by ELISA.

To test reactivity and specificity of immune serum, such as the rabbit serum derived from immunization with Tag5-produced protein of the invention, a full-length FIG. 2 cDNA is cloned into pCDNA 3.1 myc-his expression vector (Invitrogen, see the Example entitled "Production of Recombinant Targets of the Invention in Eukaryotic Systems"). After transfection of the constructs into 293T cells, cell lysates are probed with the respective anti-protein of the invention antibodies and with anti-His antibody (Santa Cruz Biotechnologies, Santa Cruz, Calif.) to determine specific reactivity of the antibodies to the respective denatured protein of the invention using the Western blot technique. Immunoprecipitation and flow cytometric analyses of 293T and other recombinant of FIG. 2-*expressing* cells determine recognition of native protein by the antibodies. In addition, Western blot, immunoprecipitation, fluorescent microscopy, and flow cytometric techniques using cells that endogenously express the protein of the invention are carried out to test specificity.

Anti-serum from rabbits immunized with target of the invention fusion proteins, such as GST and MBP fusion proteins, are purified by depletion of antibodies reactive to the fusion partner sequence by passage over an affinity column containing the fusion partner either alone or in the context of an irrelevant fusion protein. For example, antiserum derived from a GST- of a FIG. 2 fusion protein is first purified by passage over a column of GST protein covalently coupled to AffiGel matrix (BioRad, Hercules, Calif.). The antiserum is then affinity purified by passage over a column composed of a MBP-fusion protein also comprising those amino acids covalently coupled to Affigel matrix. The serum is then further purified by protein G affinity chromatography to isolate the IgG fraction. Sera from other His-tagged antigens and peptide immunized rabbits as well as fusion partner depleted sera are affinity purified by passage over a column matrix composed of the original protein immunogen or free peptide.

Example 10

Generation of Monoclonal Antibodies (mAbs) of the Invention

In one embodiment, therapeutic mAbs to a protein of the invention comprise those that react with epitopes of the protein that would disrupt or modulate the biological function of a protein of the invention, for example antibodies that disrupt its interaction with ligands and binding partners. Therapeutic mAbs also comprise those that specifically bind epitopes of a protein of the invention exposed on the cell surface and thus are useful in targeting mAb-toxin conjugates. Immunogens for generation of such mAbs include those designed to encode or contain an entire protein of the invention, regions of a protein of the invention predicted to be antigenic from computer analysis of the amino acid sequence (see, e.g., FIG. 5, FIG. 6, FIG. 7, FIG. 8, or FIG. 9, and the Example entitled "Antigenicity Profiles"), and regions such as extracellular domains. Immunogens include peptides, recombinant bacterial proteins, and mammalian expressed Tag 5 proteins and human and murine IgG FC fusion proteins. In addition, cells expressing high levels of a protein of the invention, such as 293T-protein of the invention or 300.19-protein of the invention murine Pre-B cells, are used to immunize mice.

To generate mAbs to a protein of the invention, mice are first immunized intraperitoneally (IP) with, typically, 10-50 μg of protein immunogen or $10^7$ protein of the invention-expressing cells mixed in complete Freund's adjuvant. Mice are then subsequently immunized IP every 2-4 weeks with, typically, 10-50 μg of protein immunogen or $10^7$ cells mixed in incomplete Freund's adjuvant. Alternatively, MPL-TDM adjuvant is used in immunizations. In addition to the above protein and cell-based immunization strategies, a DNA-based immunization protocol is employed in which a mammalian expression vector encoding a protein of the invention sequence is used to immunize mice by direct injection of the plasmid DNA. For example, amino acids from a protein of the invention are cloned into the Tag5 mammalian secretion vector and the recombinant vector is used as immunogen. In another example the same amino acids are cloned into an Fc-fusion secretion vector in which the protein of the invention sequence is fused at the amino-terminus to an IgK leader sequence and at the carboxyl-terminus to the coding sequence of the human or murine IgG Fc region. This recombinant vector is then used as immunogen. The plasmid immunization protocols are used in combination with purified proteins expressed from the same vector and with cells expressing protein of the invention.

During the immunization protocol, test bleeds are taken 7-10 days following an injection to monitor titer and specificity of the immune response. Once appropriate reactivity and specificity is obtained as determined by ELISA, Western blotting, immunoprecipitation, fluorescence microscopy, and flow cytometric analyses, fusion and hybridoma generation is then carried out with established procedures well known in the art (see, e.g., Harlow and Lane, 1988).

In one embodiment for generating monoclonal antibodies reactive with a protein of the invention, a Tag5-protein of the invention antigen is expressed and purified from stably transfected 293T cells. Balb C mice are initially immunized intraperitoneally with 25 μg of the Tag5-protein of the invention mixed in complete Freund's adjuvant. Mice are subsequently immunized every two weeks with 25 μg of the antigen mixed in incomplete Freund's adjuvant for a total of three immunizations. ELISA using the Tag5 antigen determines the titer of serum from immunized mice. Reactivity and specificity of serum to full length protein of the invention is monitored by Western blotting, immunoprecipitation and flow cytometry using 293T cells transfected with an expression vector encoding the protein of the invention cDNA (see e.g., the Example entitled "Production of Recombinant Targets of the Invention in Eukaryotic Systems"). Other recombinant protein of the invention-expressing cells or cells endogenously expressing a protein of the invention are also used. Mice showing the strongest reactivity are rested and given a final injection of Tag5 antigen in PBS and then sacrificed four days later. The spleens of the sacrificed mice are harvested and fused to SPO/2 myeloma cells using standard procedures (Harlow and Lane, 1988). Supernatants from HAT selected growth wells are screened by ELISA, Western blot, immunoprecipitation, fluorescent microscopy, and flow cytometry to identify protein of the invention-specific antibody-producing clones.

The binding affinity of a monoclonal antibody is determined using standard technologies. Affinity measurements quantify the strength of antibody to epitope binding and are used to help define which monoclonal antibodies reactive with proteins of the invention are suitable for diagnostic or therapeutic use, as appreciated by one of skill in the art. The BIAcore system (Uppsala, Sweden) is a useful method for determining binding affinity. The BIAcore system uses surface plasmon resonance (SPR, Welford K. 1991, Opt. Quant. Elect. 23:1; Morton and Myszka, 1998, Methods in Enzymology 295: 268) to monitor biomolecular interactions in real time. BIAcore analysis conveniently generates association rate constants, dissociation rate constants, equilibrium dissociation constants, and affinity constants.

Example 11

HLA Class I and Class II Binding Assays

HLA class I and class II binding assays using purified HLA molecules are performed in accordance with disclosed protocols (e.g., PCT publications WO 94/20127 and WO 94/03205; Sidney et al., *Current Protocols in Immunology* 18.3.1 (1998); Sidney, et al., *J. Immunol.* 154:247 (1995); Sette, et al., *Mol. Immunol.* 31:813 (1994)). Briefly, purified MHC molecules (5 to 500 nM) are incubated with various unlabeled peptide inhibitors and 1-10 nM $^{121}$I-radiolabeled probe peptides as described. Following incubation, MHC-peptide complexes are separated from free peptide by gel filtration and the fraction of peptide bound is determined. Typically, in preliminary experiments, each MHC preparation is titered in the presence of fixed amounts of radiolabeled peptides to determine the concentration of HLA molecules necessary to bind 10-20% of the total radioactivity. All subsequent inhibition and direct binding assays are performed using these HLA concentrations.

Since under these conditions [label]<[HLA] and $IC_{50} \geqq$ [HLA], the measured $IC_{50}$ values are reasonable approximations of the true $K_D$ values. Peptide inhibitors are typically tested at concentrations ranging from 120 μg/ml to 1.2 ng/ml, and are tested in two to four completely independent experiments. To allow comparison of the data obtained in different experiments, a relative binding figure is calculated for each peptide by dividing the $IC_{50}$ of a positive control for inhibition by the $IC_{50}$ for each tested peptide (typically unlabeled versions of the radiolabeled probe peptide). For database purposes, and inter-experiment comparisons, relative binding values are compiled. These values can subsequently be converted back into $IC_{50}$ nM values by dividing the $IC_{50}$ nM of the positive controls for inhibition by the relative binding of the peptide of interest. This method of data compilation is accurate and consistent for comparing peptides that have been tested on different days, or with different lots of purified MHC.

Binding assays as outlined above may be used to analyze HLA supermotif and/or HLA motif-bearing peptides.

Example 12

Identification of HLA Supermotif- and Motif-Bearing CTL Candidate Epitopes

HLA vaccine compositions of the invention can include multiple epitopes. The multiple epitopes can comprise multiple HLA supermotifs or motifs to achieve broad population coverage. This example illustrates the identification and confirmation of supermotif- and motif-bearing epitopes for the inclusion in such a vaccine composition. Calculation of population coverage is performed using the strategy described below.

Computer Searches and Algorithms for Identification of Supermotif and/or Motif-Bearing Epitopes The searches performed to identify the motif-bearing peptide sequences in the Example entitled "Antigenicity Profiles" (and, e.g., Tables V-XVIII, and Tables XXIII to XXVI) employ the protein sequence data from the protein set forth in FIGS. 2 and 3.

Computer searches for epitopes bearing HLA Class I or Class II supermotifs or motifs are performed as follows. All translated FIG. 2 protein sequences are analyzed using a text string search software program to identify potential peptide sequences containing appropriate HLA binding motifs; such programs are readily produced in accordance with information in the art in view of known motif/supermotif disclosures. Furthermore, such calculations can be made mentally.

Identified A2-, A3-, and DR-supermotif sequences are scored using polynomial algorithms to predict their capacity to bind to specific HLA-Class I or Class II molecules. These polynomial algorithms account for the impact of different amino acids at different positions, and are essentially based on the premise that the overall affinity (or ΔG) of peptide-HLA molecule interactions can be approximated as a linear polynomial function of the type:

$$\text{“}\Delta G\text{”}=a_{1i}\times a_{2i}\times a_{3i}\ldots\times a_{ni}$$

where $a_{ji}$ is a coefficient which represents the effect of the presence of a given amino acid (j) at a given position (i) along the sequence of a peptide of n amino acids. The crucial assumption of this method is that the effects at each position are essentially independent of each other (i.e., independent binding of individual side-chains). When residue j occurs at position i in the peptide, it is assumed to contribute a constant amount $j_i$ to the free energy of binding of the peptide irrespective of the sequence of the rest of the peptide.

The method of derivation of specific algorithm coefficients has been described in Gulukota et al., *J. Mol. Biol.* 267:1258-126, 1997; (see also Sidney et al., *Human Immunol.* 45:79-93, 1996; and Southwood et al., *J. Immunol.* 160:3363-3373, 1998). Briefly, for all i positions, anchor and non-anchor alike, the geometric mean of the average relative binding (ARB) of all peptides carrying j is calculated relative to the remainder of the group, and used as the estimate of $j_i$. For Class II peptides, if multiple alignments are possible, only the highest scoring alignment is utilized, following an iterative procedure. To calculate an algorithm score of a given peptide in a test set, the ARB values corresponding to the sequence of the peptide are multiplied. If this product exceeds a chosen threshold, the peptide is predicted to bind. Appropriate thresholds are chosen as a function of the degree of stringency of prediction desired.

Selection of HLA-A2 Supertype Cross-Reactive Peptides

Protein sequences from FIG. 2 proteins are scanned utilizing motif identification software, to identify 8-, 9-10- and 11-mer sequences containing the HLA-A2-supermotif main anchor specificity. Typically, these sequences are then scored using the protocol described above and the peptides corresponding to the positive-scoring sequences are synthesized and tested for their capacity to bind purified HLA-A*0201 molecules in vitro (HLA-A*0201 is considered a prototype A2 supertype molecule).

These peptides are then tested for the capacity to bind to additional A2-supertype molecules (A*0202, A*0203, A*0206, and A*6802). Peptides that bind to at least three of the five A2-supertype alleles tested are typically deemed A2-supertype cross-reactive binders. Preferred peptides bind at an affinity equal to or less than 500 nM to three or more HLA-A2 supertype molecules.

Selection of HLA-A3 Supermotif-Bearing Epitopes

The FIG. 2 protein sequence(s) scanned above are also examined for the presence of peptides with the HLA-A3-supermotif primary anchors. Peptides corresponding to the HLA A3 supermotif-bearing sequences are then synthesized and tested for binding to HLA-A*0301 and HLA-A*1101 molecules, the molecules encoded by the two most prevalent A3-supertype alleles. The peptides that bind at least one of the two alleles with binding affinities of ≦500 nM, often ≦200 nM, are then tested for binding cross-reactivity to the other common A3-supertype alleles (e.g., A*3101, A*3301, and A*6801) to identify those that can bind at least three of the five HLA-A3-supertype molecules tested.

Selection of HLA-B7 Supermotif Bearing Epitopes

The FIG. 2 protein(s) scanned above are also analyzed for the presence of 8-, 9-10-, or 11-mer peptides with the HLA-B7-supermotif. Corresponding peptides are synthesized and tested for binding to HLA-B*0702, the molecule encoded by the most common B7-supertype allele (i.e., the prototype B7 supertype allele). Peptides binding B*0702 with $IC_{50}$ of ≦500 nM are identified using standard methods. These peptides are then tested for binding to other common B7-supertype molecules (e.g., B*3501, B*5101, B*5301, and B*5401). Peptides capable of binding to three or more of the five B7-supertype alleles tested are thereby identified.

Selection of A1 and A24 Motif-Bearing Epitopes

To further increase population coverage, HLA-A1 and -A24 epitopes can also be incorporated into vaccine compositions. An analysis of the FIG. 2 proteins is performed to identify HLA-A1- and A24-motif-containing sequences.

High affinity and/or cross-reactive binding epitopes that bear other motif and/or supermotifs are identified using analogous methodology.

Example 13

Confirmation of Immunogenicity

Cross-reactive candidate CTL A2-supermotif-bearing peptides that are identified as described herein are selected to confirm in vitro immunogenicity. Conformation is performed using the following methodology:

Target Cell Lines for Cellular Screening:

The 221A2.1 cell line, produced by transferring the HLA-A2.1 gene into the HLA-A, -B, -C null mutant human B-lymphoblastoid cell line 721.221, is used as the peptide-loaded target to measure activity of HLA-A2.1-restricted CTL. This cell line is grown in RPMI-1640 medium supplemented with antibiotics, sodium pyruvate, nonessential amino acids and 10% (v/v) heat inactivated FCS. Cells that express an antigen of interest, or transfectants comprising the gene encoding the antigen of interest, can be used as target cells to confirm the ability of peptide-specific CTLs to recognize endogenous antigen.

Primary CTL Induction Cultures:

Generation of Dendritic Cells (DC): PBMCs are thawed in RPMI with 30 μg/ml DNAse, washed twice and resuspended in complete medium (RPMI-1640 plus 5% AB human serum, non-essential amino acids, sodium pyruvate, L-glutamine and penicillin/streptomycin). The monocytes are purified by plating $10\times10^6$ PBMC/well in a 6-well plate. After 2 hours at 37° C., the non-adherent cells are removed by gently shaking the plates and aspirating the supernatants. The wells are washed a total of three times with 3 ml RPMI to remove most of the non-adherent and loosely adherent cells. Three ml of complete medium containing 50 ng/ml of GM-CSF and 1,000 U/ml of IL-4 are then added to each well. TNFα is added to the DCs on day 6 at 75 ng/ml and the cells are used for CTL induction cultures on day 7.

Induction of CTL with DC and Peptide: CD8+ T-cells are isolated by positive selection with Dynal immunomagnetic beads (Dynabeads® M-450) and the detacha-bead® reagent. Typically about $200\text{-}250\times10^6$ PBMC are processed to obtain $24\times10^6$ $CD8^+$ T-cells (enough for a 48-well plate culture). Briefly, the PBMCs are thawed in RPMI with 30 μg/ml DNAse, washed once with PBS containing 1% human AB serum and resuspended in PBS/1% AB serum at a concentration of $20\times10^6$ cells/ml. The magnetic beads are washed 3 times with PBS/AB serum, added to the cells (140 μl beads/$20\times10^6$ cells) and incubated for 1 hour at 4° C. with continuous mixing. The beads and cells are washed 4× with PBS/AB serum to remove the nonadherent cells and resuspended at $100\times10^6$ cells/ml (based on the original cell number) in PBS/AB serum containing 100 μl/ml detacha-bead® reagent and 30 μg/ml DNAse. The mixture is incubated for 1 hour at room temperature with continuous mixing. The beads are washed again with PBS/AB/DNAse to collect the CD8+ T-cells. The DC are collected and centrifuged at 1300 rpm for 5-7 minutes, washed once with PBS with 1% BSA, counted and pulsed with 40 μg/ml of peptide at a cell concentration of $1\text{-}2\times10^6$/ml in the presence of 3 μg/ml $\beta_2$-microglobulin for 4 hours at 20° C. The DC are then irradiated (4,200 rads), washed 1 time with medium and counted again.

Setting up induction cultures: 0.25 ml cytokine-generated DC (at $1\times10^5$ cells/ml) are co-cultured with 0.25 ml of CD8+ T-cells (at $2\times10^6$ cell/ml) in each well of a 48-well plate in the presence of 10 ng/ml of IL-7. Recombinant human IL-10 is added the next day at a final concentration of 10 ng/ml and rhuman IL-2 is added 48 hours later at 10 IU/ml.

Restimulation of the induction cultures with peptide-pulsed adherent cells: Seven and fourteen days after the primary induction, the cells are restimulated with peptide-pulsed adherent cells. The PBMCs are thawed and washed twice with RPMI and DNAse. The cells are resuspended at $5\times10^6$ cells/ml and irradiated at ~4200 rads. The PBMCs are plated at $2\times10^6$ in 0.5 ml complete medium per well and incubated for 2 hours at 37° C. The plates are washed twice with RPMI by tapping the plate gently to remove the nonadherent cells and the adherent cells pulsed with 10 μg/ml of peptide in the presence of 3 μg/ml $\beta_2$ microglobulin in 0.25 ml RPMI/5% AB per well for 2 hours at 37° C. Peptide solution from each well is aspirated and the wells are washed once with RPMI. Most of the media is aspirated from the induction cultures (CD8+ cells) and brought to 0.5 ml with fresh media. The cells are then transferred to the wells containing the peptide-pulsed adherent cells. Twenty four hours later recombinant human IL-10 is added at a final concentration of 10 ng/ml and recombinant human IL2 is added the next day and again 2-3 days later at 50 IU/ml (Tsai et al., *Critical Reviews in Immunology,* 18(1-2):65-75, 1998). Seven days later, the cultures are assayed for CTL activity in a $^{51}Cr$ release assay. In some experiments the cultures are assayed for peptide-specific recognition in the in situ IFNγ ELISA at the time of the second restimulation followed by assay of endogenous recognition 7 days later. After expansion, activity is measured in both assays for a side-by-side comparison.

Measurement of CTL Lytic Activity by $^{51}Cr$ Release.

Seven days after the second restimulation, cytotoxicity is determined in a standard (5 hr) $^{51}Cr$ release assay by assaying individual wells at a single E:T. Peptide-pulsed targets are prepared by incubating the cells with 10 μg/ml peptide overnight at 37° C.

Adherent target cells are removed from culture flasks with trypsin-EDTA. Target cells are labeled with 200 μCi of $^{51}Cr$ sodium chromate (Dupont, Wilmington, Del.) for 1 hour at 37° C. Labeled target cells are resuspended at $10^6$ per ml and diluted 1:10 with K562 cells at a concentration of $3.3\times10^6$/ml (an NK-sensitive erythroblastoma cell line used to reduce non-specific lysis). Target cells (100 μl) and effectors (100 μl) are plated in 96 well round-bottom plates and incubated for 5 hours at 37° C. At that time, 100 μl of supernatant are collected from each well and percent lysis is determined according to the formula:

[(cpm of the test sample−cpm of the spontaneous $^{51}Cr$ release sample)/(cpm of the maximal $^{51}Cr$ release sample−cpm of the spontaneous $^{51}Cr$ release sample)]×100.

Maximum and spontaneous release are determined by incubating the labeled targets with 1% Triton X-100 and media alone, respectively. A positive culture is defined as one in which the specific lysis (sample-background) is 10% or higher in the case of individual wells and is 15% or more at the two highest E:T ratios when expanded cultures are assayed.

In Situ Measurement of Human IFNγ Production as an Indicator of Peptide-Specific and Endogenous Recognition Immulon 2 plates are coated with mouse anti-human IFNγ monoclonal antibody (4 μg/ml 0.1M $NaHCO_3$, pH8.2) overnight at 4° C. The plates are washed with $Ca^{2+}$, $Mg^{2+}$-free PBS/0.05% Tween 20 and blocked with PBS/10% FCS for two hours, after which the CTLs (100 μl/well) and targets (100 μl/well) are added to each well, leaving empty wells for the standards and blanks (which received media only). The target cells, either peptide-pulsed or endogenous targets, are used at a concentration of $1\times10^6$ cells/ml. The plates are incubated for 48 hours at 37° C. with 5% $CO_2$.

Recombinant human IFN-gamma is added to the standard wells starting at 400 pg or 1200 pg/100 microliter/well and the plate incubated for two hours at 37° C. The plates are washed and 100 μl of biotinylated mouse anti-human IFN-gamma monoclonal antibody (2 microgram/ml in PBS/3% FCS/0.05% Tween 20) are added and incubated for 2 hours at room temperature. After washing again, 100 microliter HRP-streptavidin (1:4000) are added and the plates incubated for one hour at room temperature. The plates are then washed 6× with wash buffer, 100 microliter/well developing solution (TMB 1:1) are added, and the plates allowed to develop for 5-15 minutes. The reaction is stopped with 50 microliter/well 1M $H_3PO_4$ and read at OD450. A culture is considered positive if it measured at least 50 pg of IFN-gamma/well above background and is twice the background level of expression.

CTL Expansion.

Those cultures that demonstrate specific lytic activity against peptide-pulsed targets and/or tumor targets are expanded over a two week period with anti-CD3. Briefly, $5\times10^4$ CD8+ cells are added to a T25 flask containing the following: $1\times10^6$ irradiated (4,200 rad) PBMC (autologous or allogeneic) per ml, $2\times10^5$ irradiated (8,000 rad) EBV-transformed cells per ml, and OKT3 (anti-CD3) at 30 ng per ml in RPMI-1640 containing 10% (v/v) human AB serum, non-essential amino acids, sodium pyruvate, 25 μM 2-mercaptoethanol, L-glutamine and penicillin/streptomycin. Recombinant human IL2 is added 24 hours later at a final concentration of 200 IU/ml and every three days thereafter with fresh media at 50 IU/ml. The cells are split if the cell concentration exceeds $1\times10^6$/ml and the cultures are assayed between days 13 and 15 at E:T ratios of 30, 10, 3 and 1:1 in the $^{51}$Cr release assay or at $1\times10^6$/ml in the in situ IFNγ assay using the same targets as before the expansion.

Cultures are expanded in the absence of anti-CD3$^+$ as follows. Those cultures that demonstrate specific lytic activity against peptide and endogenous targets are selected and $5\times10^4$ CD8$^+$ cells are added to a T25 flask containing the following: $1\times10^6$ autologous PBMC per ml which have been peptide-pulsed with 10 μg/ml peptide for two hours at 37° C. and irradiated (4,200 rad); $2\times10^5$ irradiated (8,000 rad) EBV-transformed cells per ml RPMI-1640 containing 10% (v/v) human AB serum, non-essential AA, sodium pyruvate, 25 mM 2-ME, L-glutamine and gentamicin.

Immunogenicity of A2 Supermotif-Bearing Peptides

A2-supermotif cross-reactive binding peptides are tested in the cellular assay for the ability to induce peptide-specific CTL in normal individuals. In this analysis, a peptide is typically considered to be an epitope if it induces peptide-specific CTLs in at least individuals, and preferably, also recognizes the endogenously expressed peptide.

Immunogenicity can also be confirmed using PBMCs isolated from patients bearing a tumor that expresses a FIG. 2 protein. Briefly, PBMCs are isolated from patients, re-stimulated with peptide-pulsed monocytes and assayed for the ability to recognize peptide-pulsed target cells as well as transfected cells endogenously expressing the antigen.

Evaluation of A*03/A11 Immunogenicity

HLA-A3 supermotif-bearing cross-reactive binding peptides are also evaluated for immunogenicity using methodology analogous for that used to evaluate the immunogenicity of the HLA-A2 supermotif peptides.

Evaluation of B7 Immunogenicity

Immunogenicity screening of the B7-supertype cross-reactive binding peptides identified as set forth herein are confirmed in a manner analogous to the confirmation of A2- and A3-supermotif-bearing peptides.

Peptides bearing other supermotifs/motifs, e.g., HLA-A1, HLA-A24 etc. are also confirmed using similar methodology Example 14

Implementation of the Extended Supermotif to Improve the Binding Capacity of Native Epitopes by Creating Analogs HLA motifs and supermotifs (comprising primary and/or secondary residues) are useful in the identification and preparation of highly cross-reactive native peptides, as demonstrated herein. Moreover, the definition of HLA motifs and supermotifs also allows one to engineer highly cross-reactive epitopes by identifying residues within a native peptide sequence which can be analoged to confer upon the peptide certain characteristics, e.g. greater cross-reactivity within the group of HLA molecules that comprise a supertype, and/or greater binding affinity for some or all of those HLA molecules. Examples of analoging peptides to exhibit modulated binding affinity are set forth in this example.

Analoging at Primary Anchor Residues

Peptide engineering strategies are implemented to further increase the cross-reactivity of the epitopes. For example, the main anchors of A2-supermotif-bearing peptides are altered, for example, to introduce a preferred L, I, V, or M at position 2, and I or V at the C-terminus.

To analyze the cross-reactivity of the analog peptides, each engineered analog is initially tested for binding to the prototype A2 supertype allele A*0201, then, if A*0201 binding capacity is maintained, for A2-supertype cross-reactivity.

Alternatively, a peptide is confirmed as binding one or all supertype members and then analoged to modulate binding affinity to any one (or more) of the supertype members to add population coverage.

The selection of analogs for immunogenicity in a cellular screening analysis is typically further restricted by the capacity of the parent wild type (WT) peptide to bind at least weakly, i.e., bind at an $IC_{50}$ of 5000 nM or less, to three of more A2 supertype alleles. The rationale for this requirement is that the WT peptides must be present endogenously in sufficient quantity to be biologically relevant. Analoged peptides have been shown to have increased immunogenicity and cross-reactivity by T cells specific for the parent epitope (see, e.g., Parkhurst et al., *J. Immunol.* 157:2539, 1996; and Pogue et al., *Proc. Natl. Acad. Sci. USA* 92:8166, 1995).

In the cellular screening of these peptide analogs, it is important to confirm that analog-specific CTLs are also able to recognize the wild-type peptide and, when possible, target cells that endogenously express the epitope.

Analoging of HLA-A3 and B7-Supermotif-Bearing Peptides

Analogs of HLA-A3 supermotif-bearing epitopes are generated using strategies similar to those employed in analoging HLA-A2 supermotif-bearing peptides. For example, peptides binding to 3/5 of the A3-supertype molecules are engineered at primary anchor residues to possess a preferred residue (V, S, M, or A) at position 2.

The analog peptides are then tested for the ability to bind A*03 and A*11 (prototype A3 supertype alleles). Those peptides that demonstrate ≦500 nM binding capacity are then confirmed as having A3-supertype cross-reactivity.

Similarly to the A2- and A3-motif bearing peptides, peptides binding 3 or more B7-supertype alleles can be improved, where possible, to achieve increased cross-reactive binding or greater binding affinity or binding half life. B7 supermotif-bearing peptides are, for example, engineered to possess a preferred residue (V, I, L, or F) at the C-terminal primary anchor position, as demonstrated by Sidney et al. (*J. Immunol.* 157:3480-3490, 1996).

Analoging at primary anchor residues of other motif and/or supermotif-bearing epitopes is performed in a like manner.

The analog peptides are then be confirmed for immunogenicity, typically in a cellular screening assay. Again, it is generally important to demonstrate that analog-specific CTLs are also able to recognize the wild-type peptide and, when possible, targets that endogenously express the epitope.

Analoging at Secondary Anchor Residues

Moreover, HLA supermotifs are of value in engineering highly cross-reactive peptides and/or peptides that bind HLA molecules with increased affinity by identifying particular residues at secondary anchor positions that are associated with such properties. For example, the binding capacity of a B7 supermotif-bearing peptide with an F residue at position 1 is analyzed. The peptide is then analoged to, for example, substitute L for F at position 1. The analoged peptide is evaluated for increased binding affinity, binding half life and/or increased cross-reactivity. Such a procedure identifies analoged peptides with enhanced properties.

Engineered analogs with sufficiently improved binding capacity or cross-reactivity can also be tested for immunogenicity in HLA-B7-transgenic mice, following for example, IFA immunization or lipopeptide immunization. Analoged peptides are additionally tested for the ability to stimulate a recall response using PBMC from patients with protein(s) of FIG. 2-*expressing* tumors.

Other Analoging Strategies

Another form of peptide analoging, unrelated to anchor positions, involves the substitution of a cysteine with α-amino butyric acid. Due to its chemical nature, cysteine has the propensity to form disulfide bridges and sufficiently alter the peptide structurally so as to reduce binding capacity. Substitution of α-amino butyric acid for cysteine not only alleviates this problem, but has been shown to improve binding and crossbinding capabilities in some instances (see, e.g., the review by Sette et al., In: Persistent Viral Infections, Eds. R. Ahmed and I. Chen, John Wiley & Sons, England, 1999).

Thus, by the use of single amino acid substitutions, the binding properties and/or cross-reactivity of peptide ligands for HLA supertype molecules can be modulated.

Example 15

Identification of HLA-DR Binding Motifs in Proteins of FIG. 2

Peptide epitopes bearing an HLA class II supermotif or motif are identified and confirmed as outlined below using methodology similar to that described for HLA Class I peptides.

Selection of HLA-DR-Supermotif-Bearing Epitopes.

To identify HLA class II HTL epitopes derived from a protein of FIG. 2, a FIG. 2 antigen is analyzed for the presence of sequences bearing an HLA-DR-motif or supermotif. Specifically, 15-mer sequences are selected comprising a DR-supermotif, comprising a 9-mer core, and three-residue N- and C-terminal flanking regions (15 amino acids total).

Protocols for predicting peptide binding to DR molecules have been developed (Southwood et al., *J. Immunol.* 160: 3363-3373, 1998). These protocols, specific for individual DR molecules, allow the scoring, and ranking, of 9-mer core regions. Each protocol not only scores peptide sequences for the presence of DR-supermotif primary anchors (i.e., at position 1 and position 6) within a 9-mer core, but also additionally evaluates sequences for the presence of secondary anchors. Using allele-specific selection tables (see, e.g., Southwood et al., ibid.), it has been found that these protocols efficiently select peptide sequences with a high probability of binding a particular DR molecule. Additionally, it has been found that performing these protocols in tandem, specifically those for DR1, DR4w4, and DR7, can efficiently select DR cross-reactive peptides.

The protein in FIG. 2-*derived* peptides identified above are tested for their binding capacity for various common HLA-DR molecules. All peptides are initially tested for binding to the DR molecules in the primary panel: DR1, DR4w4, and DR7. Peptides binding at least two of these three DR molecules are then tested for binding to DR2w2 β1, DR2w2 β2, DR6w19, and DR9 molecules in secondary assays. Finally, peptides binding at least two of the four secondary panel DR molecules, and thus cumulatively at least four of seven different DR molecules, are screened for binding to DR4w15, DR5w11, and DR8w2 molecules in tertiary assays. Peptides binding at least seven of the ten DR molecules comprising the primary, secondary, and tertiary screening assays are considered cross-reactive DR binders. Proteins in FIG. 2-*derived* peptides found to bind common HLA-DR alleles are of particular interest.

Selection of DR3 Motif Peptides

Because HLA-DR3 is an allele that is prevalent in Caucasian, Black, and Hispanic populations, DR3 binding capacity is a relevant criterion in the selection of HTL epitopes. Thus, peptides shown to be candidates may also be assayed for their DR3 binding capacity. However, in view of the binding specificity of the DR3 motif, peptides binding only to DR3 can also be considered as candidates for inclusion in a vaccine formulation.

To efficiently identify peptides that bind DR3, FIG. 2 antigens are analyzed for sequences carrying one of the two DR3-specific binding motifs reported by Geluk et al. (*J. Immunol.* 152:5742-5748, 1994). The corresponding peptides are then synthesized and confirmed as having the ability to bind DR3 with an affinity of 1 μM or better, i.e., less than 1 μM. Peptides are found that meet this binding criterion and qualify as HLA class II high affinity binders.

DR3 binding epitopes identified in this manner are included in vaccine compositions with DR supermotif-bearing peptide epitopes.

Similarly to the case of HLA class I motif-bearing peptides, the class II motif-bearing peptides are analoged to improve affinity or cross-reactivity. For example, aspartic acid at position 4 of the 9-mer core sequence is an optimal residue for DR3 binding, and substitution for that residue often improves DR 3 binding.

Example 16

Immunogenicity of HTL Epitopes Derived from a Protein of FIG. 2

This example determines immunogenic DR supermotif- and DR3 motif-bearing epitopes among those identified using the methodology set forth herein.

Immunogenicity of HTL epitopes are confirmed in a manner analogous to the determination of immunogenicity of CTL epitopes, by assessing the ability to stimulate HTL responses and/or by using appropriate transgenic mouse models. Immunogenicity is determined by screening for: 1.)

in vitro primary induction using normal PBMC or 2.) recall responses from patients who have proteins of FIG. 2-*expressing* tumors.

Example 17

Calculation of Phenotypic Frequencies of HLA-Supertypes in Various Ethnic Backgrounds to Determine Breadth of Population Coverage This example illustrates the assessment of the breadth of population coverage of a vaccine composition comprised of multiple epitopes comprising multiple supermotifs and/or motifs.

In order to analyze population coverage, gene frequencies of HLA alleles are determined. Gene frequencies for each HLA allele are calculated from antigen or allele frequencies utilizing the binomial distribution formulae gf-1-(SQRT(1-af)) (see, e.g., Sidney et al., *Human Immunol.* 45:79-93, 1996). To obtain overall phenotypic frequencies, cumulative gene frequencies are calculated, and the cumulative antigen frequencies derived by the use of the inverse formula [af=1−(1−Cgf)$^2$].

Where frequency data is not available at the level of DNA typing, correspondence to the serologically defined antigen frequencies is assumed. To obtain total potential supertype population coverage no linkage disequilibrium is assumed, and only alleles confirmed to belong to each of the supertypes are included (minimal estimates). Estimates of total potential coverage achieved by inter-loci combinations are made by adding to the A coverage the proportion of the non-A covered population that could be expected to be covered by the B alleles considered (e.g., total=A+B*(1−A)). Confirmed members of the A3-like supertype are A3, A11, A31, A*3301, and A*6801. Although the A3-like supertype may also include A34, A66, and A*7401, these alleles were not included in overall frequency calculations. Likewise, confirmed members of the A2-like supertype family are A*0201, A*0202, A*0203, A*0204, A*0205, A*0206, A*0207, A*6802, and A*6901. Finally, the B7-like supertype-confirmed alleles are: B7, B*3501-03, B51, B*5301, B*5401, B*5501-2, B*5601, B*6701, and B*7801 (potentially also B*1401, B*3504-06, B*4201, and B*5602).

Population coverage achieved by combining the A2-, A3- and B7-supertypes is approximately 86% in five major ethnic groups. Coverage may be extended by including peptides bearing the A1 and A24 motifs. On average, A1 is present in 12% and A24 in 29% of the population across five different major ethnic groups (Caucasian, North American Black, Chinese, Japanese, and Hispanic). Together, these alleles are represented with an average frequency of 39% in these same ethnic populations. The total coverage across the major ethnicities when A1 and A24 are combined with the coverage of the A2-, A3- and B7-supertype alleles is >95%. An analogous approach can be used to estimate population coverage achieved with combinations of class II motif-bearing epitopes.

Immunogenicity studies in humans (e.g., Bertoni et al., *J. Clin. Invest.* 100:503, 1997; Doolan et al., *Immunity* 7:97, 1997; and Threlkeld et al., *J. Immunol.* 159:1648, 1997) have shown that highly cross-reactive binding peptides are almost always recognized as epitopes. The use of highly cross-reactive binding peptides is an important selection criterion in identifying candidate epitopes for inclusion in a vaccine that is immunogenic in a diverse population.

With a sufficient number of epitopes (as disclosed herein and from the art), an average population coverage is predicted to be greater than 95% in each of five major ethnic populations. The game theory Monte Carlo simulation analysis, which is known in the art (see e.g., Osborne, M. J. and Rubinstein, A. "A course in game theory" MIT Press, 1994), can be used to estimate what percentage of the individuals in a population comprised of the Caucasian, North American Black, Japanese, Chinese, and Hispanic ethnic groups would recognize the vaccine epitopes described herein. A preferred percentage is 90%. A more preferred percentage is 95%.

Example 18

CTL Recognition of Endogenously Processed Antigens After Priming

This example confirms that CTL induced by native or analoged peptide epitopes identified and selected as described herein recognize endogenously synthesized, i.e., native antigens.

Effector cells isolated from transgenic mice that are immunized with peptide epitopes, for example HLA-A2 supermotif-bearing epitopes, are re-stimulated in vitro using peptide-coated stimulator cells. Six days later, effector cells are assayed for cytotoxicity and the cell lines that contain peptide-specific cytotoxic activity are further re-stimulated. An additional six days later, these cell lines are tested for cytotoxic activity on $^{51}Cr$ labeled Jurkat-A2.1/K$^b$ target cells in the absence or presence of peptide, and also tested on $^{51}Cr$ labeled target cells bearing the endogenously synthesized antigen, i.e. cells that are stably transfected with a gene of FIG. 2-*related* expression vector.

The results demonstrate that CTL lines obtained from animals primed with peptide epitopes recognize endogenously synthesized FIG. 2 antigens. The choice of transgenic mouse model to be used for such an analysis depends upon the epitope(s) that are being evaluated. In addition to HLA-A*0201/K$^b$ transgenic mice, several other transgenic mouse models including mice with human A11, which may also be used to evaluate A3 epitopes, and B7 alleles have been characterized and others (e.g., transgenic mice for HLA-A1 and A24) are being developed. HLA-DR1 and HLA-DR3 mouse models have also been developed, which may be used to evaluate HTL epitopes.

Example 19

Activity of CTL-HTL Conjugated Epitopes in Transgenic Mice

This example illustrates the induction of CTLs and HTLs in transgenic mice, by use of a protein of FIG. 2-*derived* CTL and HTL peptide vaccine compositions. The vaccine compositions used herein comprise peptides to be administered to a patient with a protein of FIG. 2-*expressing* tumor. The peptide composition can comprise multiple CTL and/or HTL epitopes. The epitopes are identified using methodology as described herein. This example also illustrates that enhanced immunogenicity can be achieved by inclusion of one or more HTL epitopes in a CTL vaccine composition; such a peptide composition can comprise an HTL epitope conjugated to a CTL epitope. The CTL epitope can be one that binds to multiple HLA family members at an affinity of 500 nM or less, or analogs of that epitope. The peptides may be lipidated, if desired.

Immunization procedures: Immunization of transgenic mice is performed as described (Alexander et al, *J. Immunol.* 159:4753-4761, 1997). For example, A2/K$^b$ mice, which are transgenic for the human HLA A2.1 allele and are used to confirm the immunogenicity of HLA-A*0201 motif- or HLA-A2 supermotif-bearing epitopes, and are primed subcutaneously (base of the tail) with a 0.1 ml of peptide in Incomplete Freund's Adjuvant, or if the peptide composition is a lipidated CTL/HTL conjugate, in DMSO/saline, or if the peptide composition is a polypeptide, in PBS or Incomplete Freund's Adjuvant. Seven days after priming, splenocytes obtained from these animals are restimulated with syngenic irradiated LPS-activated lymphoblasts coated with peptide.

Cell lines: Target cells for peptide-specific cytotoxicity assays are Jurkat cells transfected with the HLA-A2.1/$K^b$ chimeric gene (e.g., Vitiello et al., *J. Exp. Med* 173:1007, 1991)

In vitro CTL activation: One week after priming, spleen cells ($30\times10^6$ cells/flask) are co-cultured at 37° C. with syngeneic, irradiated (3000 rads), peptide coated lymphoblasts ($10\times10^6$ cells/flask) in 10 ml of culture medium/T25 flask. After six days, effector cells are harvested and assayed for cytotoxic activity.

Assay for cytotoxic activity: Target cells (1.0 to $1.5\times10^6$) are incubated at 37° C. in the presence of 200 µl of $^{51}Cr$. After 60 minutes, cells are washed three times and resuspended in R10 medium. Peptide is added where required at a concentration of 1 µg/ml. For the assay, $10^4$ $^{51}Cr$-labeled target cells are added to different concentrations of effector cells (final volume of 200 µl) in U-bottom 96-well plates. After a six hour incubation period at 37° C., a 0.1 ml aliquot of supernatant is removed from each well and radioactivity is determined in a Micromedic automatic gamma counter. The percent specific lysis is determined by the formula: percent specific release=100×(experimental release−spontaneous release)/(maximum release−spontaneous release). To facilitate comparison between separate CTL assays run under the same conditions, % $^{51}Cr$ release data is expressed as lytic units/$10^6$ cells. One lytic unit is arbitrarily defined as the number of effector cells required to achieve 30% lysis of 10,000 target cells in a six hour $^{51}Cr$ release assay. To obtain specific lytic units/$10^6$, the lytic units/$10^6$ obtained in the absence of peptide is subtracted from the lytic units/$10^6$ obtained in the presence of peptide. For example, if 30% $^{51}Cr$ release is obtained at the effector (E): target (T) ratio of 50:1 (i.e., $5\times10^5$ effector cells for 10,000 targets) in the absence of peptide and 5:1 (i.e., $5\times10^4$ effector cells for 10,000 targets) in the presence of peptide, the specific lytic units would be: $[(1/50,000)-(1/500,000)]\times10^6=18$ LU.

The results are analyzed to assess the magnitude of the CTL responses of animals injected with the immunogenic CTL/HTL conjugate vaccine preparation and are compared to the magnitude of the CTL response achieved using, for example, CTL epitopes as outlined above in the Example entitled "Confirmation of Immunogenicity". Analyses similar to this may be performed to confirm the immunogenicity of peptide conjugates containing multiple CTL epitopes and/or multiple HTL epitopes. In accordance with these procedures, it is found that a CTL response is induced, and concomitantly that an HTL response is induced upon administration of such compositions.

Example 20

Selection of CTL and HTL Epitopes for Inclusion in a Vaccine Specific for a Protein of FIG. 2

This example illustrates a procedure for selecting peptide epitopes for vaccine compositions of the invention. The peptides in the composition can be in the form of a nucleic acid sequence, either single or one or more sequences (i.e., minigene) that encodes peptide(s), or can be single and/or polyepitopic peptides.

The following principles are utilized when selecting a plurality of epitopes for inclusion in a vaccine composition. Each of the following principles is balanced in order to make the selection.

Epitopes are selected which, upon administration, mimic immune responses that are correlated with FIG. 2 protein clearance. The number of epitopes used depends on observations of patients who spontaneously clear a FIG. 2 protein. For example, if it has been observed that patients who spontaneously clear a FIG. 2 protein generate an immune response to at least three (3) epitopes from a protein of FIG. 2 antigen, then at least three epitopes should be included for HLA class I. A similar rationale is used to determine HLA class II epitopes.

Epitopes are often selected that have a binding affinity of an $IC_{50}$ of 500 nM or less for an HLA class I molecule, or for class II, an $IC_{50}$ of 1000 nM or less; or HLA Class I peptides with high binding scores.

In order to achieve broad coverage of the vaccine through out a diverse population, sufficient supermotif bearing peptides, or a sufficient array of allele-specific motif bearing peptides, are selected to give broad population coverage. In one embodiment, epitopes are selected to provide at least 80% population coverage. A Monte Carlo analysis, a statistical evaluation known in the art, can be employed to assess breadth, or redundancy, of population coverage.

When creating polyepitopic compositions, or a minigene that encodes same, it is typically desirable to generate the smallest peptide possible that encompasses the epitopes of interest. The principles employed are similar, if not the same, as those employed when selecting a peptide comprising nested epitopes. For example, a protein sequence for the vaccine composition is selected because it has maximal number of epitopes contained within the sequence, i.e., it has a high concentration of epitopes. Epitopes may be nested or overlapping (i.e., frame shifted relative to one another). For example, with overlapping epitopes, two 9-mer epitopes and one 10-mer epitope can be present in a 10 amino acid peptide. Each epitope can be exposed and bound by an HLA molecule upon administration of such a peptide. A multi-epitopic, peptide can be generated synthetically, recombinantly, or via cleavage from the native source. Alternatively, an analog can be made of this native sequence, whereby one or more of the epitopes comprise substitutions that alter the cross-reactivity and/or binding affinity properties of the polyepitopic peptide. Such a vaccine composition is administered for therapeutic or prophylactic purposes. This embodiment provides for the possibility that an as yet undiscovered aspect of immune system processing will apply to the native nested sequence and thereby facilitate the production of therapeutic or prophylactic immune response-inducing vaccine compositions. Additionally such an embodiment provides for the possibility of motif-bearing epitopes for an HLA makeup that is presently unknown. Furthermore, this embodiment (absent the creating of any analogs) directs the immune response to multiple peptide sequences that are actually present in FIG. 2 proteins, thus avoiding the need to evaluate any junctional epitopes. Lastly, the embodiment provides an economy of scale when producing nucleic acid vaccine compositions. Related to this embodiment, computer programs can be derived in accordance with principles in the art, which identify in a target sequence, the greatest number of epitopes per sequence length.

A vaccine composition comprised of selected peptides, when administered, is safe, efficacious, and elicits an immune response similar in magnitude to an immune response that controls or clears cells that bear or overexpress a FIG. 2 protein.

Example 21

Construction of "Minigene" Multi-Epitope DNA Plasmids

This example discusses the construction of a minigene expression plasmid. Minigene plasmids may, of course, contain various configurations of B cell, CTL and/or HTL epitopes or epitope analogs as described herein.

A minigene expression plasmid typically includes multiple CTL and HTL peptide epitopes. In the present example, HLA-A2, -A3, -B7 supermotif-bearing peptide epitopes and HLA-A1 and -A24 motif-bearing peptide epitopes are used in conjunction with DR supermotif-bearing epitopes and/or DR3 epitopes. HLA class I supermotif or motif-bearing peptide epitopes derived from a protein of FIG. 2, are selected such that multiple supermotifs/motifs are represented to ensure broad population coverage. Similarly, HLA class II epitopes are selected from a FIG. 2 protein to provide broad population coverage, i.e. both HLA DR-1-4-7 supermotif-bearing epitopes and HLA DR-3 motif-bearing epitopes are selected for inclusion in the minigene construct. The selected CTL and HTL epitopes are then incorporated into a minigene for expression in an expression vector.

Such a construct may additionally include sequences that direct the HTL epitopes to the endoplasmic reticulum. For example, the Ii protein may be fused to one or more HTL epitopes as described in the art, wherein the CLIP sequence of the Ii protein is removed and replaced with an HLA class II epitope sequence so that HLA class II epitope is directed to the endoplasmic reticulum, where the epitope binds to an HLA class II molecules.

This example illustrates the methods to be used for construction of a minigene-bearing expression plasmid. Other expression vectors that may be used for minigene compositions are available and known to those of skill in the art.

The minigene DNA plasmid of this example contains a consensus Kozak sequence and a consensus murine kappa Ig-light chain signal sequence followed by CTL and/or HTL epitopes selected in accordance with principles disclosed herein. The sequence encodes an open reading frame fused to the Myc and His antibody epitope tag coded for by the pcDNA 3.1 Myc-His vector.

Overlapping oligonucleotides that can, for example, average about 70 nucleotides in length with 15 nucleotide overlaps, are synthesized and HPLC-purified. The oligonucleotides encode the selected peptide epitopes as well as appropriate linker nucleotides, Kozak sequence, and signal sequence. The final multiepitope minigene is assembled by extending the overlapping oligonucleotides in three sets of reactions using PCR. A Perkin/Elmer 9600 PCR machine is used and a total of 30 cycles are performed using the following conditions: 95° C. for 15 sec, annealing temperature (5° below the lowest calculated Tm of each primer pair) for 30 sec, and 72° C. for 1 min.

For example, a minigene is prepared as follows. For a first PCR reaction, 5 μg of each of two oligonucleotides are annealed and extended: In an example using eight oligonucleotides, i.e., four pairs of primers, oligonucleotides 1+2, 3+4, 5+6, and 7+8 are combined in 100 μl reactions containing Pfu polymerase buffer (1×=10 mM KCL, 10 mM $(NH4)_2SO_4$, 20 mM Tris-chloride, pH 8.75, 2 mM $MgSO_4$, 0.1% Triton X-100, 100 μg/ml BSA), 0.25 mM each dNTP, and 2.5 U of Pfu polymerase. The full-length dimer products are gel-purified, and two reactions containing the product of 1+2 and 3+4, and the product of 5+6 and 7+8 are mixed, annealed, and extended for 10 cycles. Half of the two reactions are then mixed, and 5 cycles of annealing and extension carried out before flanking primers are added to amplify the full length product. The full-length product is gel-purified and cloned into pCR-blunt (Invitrogen) and individual clones are screened by sequencing.

Example 22

The Plasmid Construct and the Degree to which it Induces Immunogenicity

The degree to which a plasmid construct, for example a plasmid constructed in accordance with the previous Example, is able to induce immunogenicity is confirmed in vitro by determining epitope presentation by APC following transduction or transfection of the APC with an epitope-expressing nucleic acid construct. Such a study determines "antigenicity" and allows the use of human APC. The assay determines the ability of the epitope to be presented by the APC in a context that is recognized by a T cell by quantifying the density of epitope-HLA class I complexes on the cell surface. Quantitation can be performed by directly measuring the amount of peptide eluted from the APC (see, e.g., Sijts et al., *J. Immunol.* 156:683-692, 1996; Demotz et al., *Nature* 342:682-684, 1989); or the number of peptide-HLA class I complexes can be estimated by measuring the amount of lysis or lymphokine release induced by diseased or transfected target cells, and then determining the concentration of peptide necessary to obtain equivalent levels of lysis or lymphokine release (see, e.g., Kageyama et al., *J. Immunol.* 154:567-576, 1995).

Alternatively, immunogenicity is confirmed through in vivo injections into mice and subsequent in vitro assessment of CTL and HTL activity, which are analyzed using cytotoxicity and proliferation assays, respectively, as detailed e.g., in Alexander et al., *Immunity* 1:751-761, 1994.

For example, to confirm the capacity of a DNA minigene construct containing at least one HLA-A2 supermotif peptide to induce CTLs in vivo, HLA-A2.1/$K^b$ transgenic mice, for example, are immunized intramuscularly with 100 μg of naked cDNA. As a means of comparing the level of CTLs induced by cDNA immunization, a control group of animals is also immunized with an actual peptide composition that comprises multiple epitopes synthesized as a single polypeptide as they would be encoded by the minigene.

Splenocytes from immunized animals are stimulated twice with each of the respective compositions (peptide epitopes encoded in the minigene or the polyepitopic peptide), then assayed for peptide-specific cytotoxic activity in a $^{51}Cr$ release assay. The results indicate the magnitude of the CTL response directed against the A2-restricted epitope, thus indicating the in vivo immunogenicity of the minigene vaccine and polyepitopic vaccine.

It is, therefore, found that the minigene elicits immune responses directed toward the HLA-A2 supermotif peptide epitopes as does the polyepitopic peptide vaccine. A similar analysis is also performed using other HLA-A3 and HLA-B7 transgenic mouse models to assess CTL induction by HLA-A3 and HLA-B7 motif or supermotif epitopes, whereby it is also found that the minigene elicits appropriate immune responses directed toward the provided epitopes.

To confirm the capacity of a class II epitope-encoding minigene to induce HTLs in vivo, DR transgenic mice, or for those epitopes that cross react with the appropriate mouse MHC molecule, I-$A^b$-restricted mice, for example, are immunized intramuscularly with 100 μg of plasmid DNA. As a means of comparing the level of HTLs induced by DNA immunization, a group of control animals is also immunized with an actual peptide composition emulsified in complete Freund's adjuvant. CD4+ T cells, i.e. HTLs, are purified from splenocytes of immunized animals and stimulated with each of the respective compositions (peptides encoded in the minigene). The HTL response is measured using a $^3$H-thymidine incorporation proliferation assay, (see, e.g., Alexander et al. Immunity 1:751-761, 1994). The results indicate the magnitude of the HTL response, thus demonstrating the in vivo immunogenicity of the minigene.

DNA minigenes, constructed as described in the previous Example, can also be confirmed as a vaccine in combination with a boosting agent using a prime boost protocol. The boosting agent can consist of recombinant protein (e.g., Barnett et al., *Aids Res. and Human Retroviruses* 14, Supplement 3:S299-S309, 1998) or recombinant vaccinia, for example, expressing a minigene or DNA encoding the complete protein of interest (see, e.g., Hanke et al., *Vaccine* 16:439-445, 1998; Sedegah et al., *Proc. Natl. Acad. Sci USA* 95:7648-53, 1998; Hanke and McMichael, *Immunol. Letters* 66:177-181, 1999; and Robinson et al., *Nature Med* 5:526-34, 1999).

For example, the efficacy of the DNA minigene used in a prime boost protocol is initially evaluated in transgenic mice. In this example, A2.1/$K^b$ transgenic mice are immunized 1M with 100 μg of a DNA minigene encoding the immunogenic peptides including at least one HLA-A2 supermotif-bearing peptide. After an incubation period (ranging from 3-9 weeks), the mice are boosted IP with $10^7$ pfu/mouse of a recombinant vaccinia virus expressing the same sequence encoded by the DNA minigene. Control mice are immunized with 100 μg of DNA or recombinant vaccinia without the minigene sequence, or with DNA encoding the minigene, but without the vaccinia boost. After an additional incubation period of two weeks, splenocytes from the mice are immediately assayed for peptide-specific activity in an ELISPOT assay. Additionally, splenocytes are stimulated in vitro with the A2-restricted peptide epitopes encoded in the minigene and recombinant vaccinia, then assayed for peptide-specific activity in an alpha, beta and/or gamma IFN ELISA.

It is found that the minigene utilized in a prime-boost protocol elicits greater immune responses toward the HLA-A2 supermotif peptides than with DNA alone. Such an analysis can also be performed using HLA-A11 or HLA-B7 transgenic mouse models to assess CTL induction by HLA-A3 or HLA-B7 motif or supermotif epitopes. The use of prime boost protocols in humans is described below in the Example entitled "Induction of CTL Responses Using a Prime Boost Protocol."

Example 23

Peptide Compositions for Prophylactic Uses

Vaccine compositions of the present invention can be used to prevent a gene of FIG. 2 expression in persons who are at risk for tumors that bear this antigen. For example, a polyepitopic peptide epitope composition (or a nucleic acid comprising the same) containing multiple CTL and HTL epitopes such as those selected in the above Examples, which are also selected to target greater than 80% of the population, is administered to individuals at risk for a protein of FIG. 2-*associated* tumor.

For example, a peptide-based composition is provided as a single polypeptide that encompasses multiple epitopes. The vaccine is typically administered in a physiological solution that comprises an adjuvant, such as Incomplete Freunds Adjuvant. The dose of peptide for the initial immunization is from about 1 to about 50,000 μg, generally 100-5,000 μg, for a 70 kg patient. The initial administration of vaccine is followed by booster dosages at 4 weeks followed by evaluation of the magnitude of the immune response in the patient, by techniques that determine the presence of epitope-specific CTL populations in a PBMC sample. Additional booster doses are administered as required. The composition is found to be both safe and efficacious as a prophylaxis against protein of FIG. 2-*associated* disease.

Alternatively, a composition typically comprising transfecting agents is used for the administration of a nucleic acid-based vaccine in accordance with methodologies known in the art and disclosed herein.

Example 24

Polyepitopic Vaccine Compositions Derived from Native Protein Sequence of FIG. 2

A native FIG. 2 protein sequence is analyzed, preferably using computer algorithms defined for each class I and/or class II supermotif or motif, to identify "relatively short" regions of the polyprotein that comprise multiple epitopes. The "relatively short" regions are preferably less in length than an entire native antigen. This relatively short sequence that contains multiple distinct or overlapping, "nested" epitopes is selected; it can be used to generate a minigene construct. The construct is engineered to express the peptide, which corresponds to the native protein sequence. The "relatively short" peptide is generally less than 250 amino acids in length, often less than 100 amino acids in length, preferably less than 75 amino acids in length, and more preferably less than 50 amino acids in length. The protein sequence of the vaccine composition is selected because it has maximal number of epitopes contained within the sequence, i.e., it has a high concentration of epitopes. As noted herein, epitope motifs may be nested or overlapping (i.e., frame shifted relative to one another). For example, with overlapping epitopes, two 9-mer epitopes and one 10-mer epitope can be present in a 10 amino acid peptide. Such a vaccine composition is administered for therapeutic or prophylactic purposes.

The vaccine composition will include, for example, multiple CTL epitopes from a protein antigen of the invention and at least one HTL epitope. This polyepitopic native sequence is administered either as a peptide or as a nucleic acid sequence which encodes the peptide. Alternatively, an analog can be made of this native sequence, whereby one or more of the epitopes comprise substitutions that alter the cross-reactivity and/or binding affinity properties of the polyepitopic peptide.

The embodiment of this example provides for the possibility that an as yet undiscovered aspect of immune system processing will apply to the native nested sequence and thereby facilitate the production of therapeutic or prophylactic immune response-inducing vaccine compositions. Additionally such an embodiment provides for the possibility of motif-bearing epitopes for an HLA makeup that is presently unknown. Furthermore, this embodiment (excluding an analoged embodiment) directs the immune response to multiple peptide sequences that are actually present in native proteins of the invention, thus avoiding the need to evaluate any junctional epitopes. Lastly, the embodiment provides an economy of scale when producing peptide or nucleic acid vaccine compositions.

Related to this embodiment, computer programs are available in the art which can be used to identify in a target sequence, the greatest number of epitopes per sequence length.

Example 25

Polyepitopic Vaccine Compositions from Multiple Antigens

The protein peptide epitopes of the present invention are used in conjunction with epitopes from other target tumor-associated antigens (such as from one or more proteins of FIG. 2), to create a vaccine composition that is useful for the prevention or treatment of cancer that expresses protein(s) of the invention and such other antigens. For example, a vaccine composition can be provided as a single polypeptide that incorporates multiple epitopes from a protein of the invention as well as tumor-associated antigens that are often expressed with the particular target cancer that is also associated with expression of a protein of the invention, or can be administered as a composition comprising a cocktail of one or more discrete epitopes. Alternatively, the vaccine can be administered as a minigene construct or as dendritic cells which have been loaded with the peptide epitopes in vitro.

Example 26

Use of Peptides to Evaluate an Immune Response

Peptides of the invention may be used to analyze an immune response for the presence of specific antibodies, CTL or HTL directed to a protein of the invention. Such an analysis can be performed in a manner described by Ogg et al., *Science* 279:2103-2106, 1998. In this Example, peptides in accordance with the invention are used as a reagent for diagnostic or prognostic purposes, not as an immunogen.

In this example highly sensitive human leukocyte antigen tetrameric complexes ("tetramers") are used for a cross-sectional analysis of, for example, a protein of FIG. 2 HLA-A*0201-specific CTL frequencies from HLA A*0201-positive individuals at different stages of disease or following immunization comprising a protein of FIG. 2 peptide containing an A*0201 motif. Tetrameric complexes are synthesized as described (Musey et al., N. *Engl. J. Med.* 337:1267, 1997). Briefly, purified HLA heavy chain (A*0201 in this example) and β2-microglobulin are synthesized by means of a prokaryotic expression system. The heavy chain is modified by deletion of the transmembrane-cytosolic tail and COOH-terminal addition of a sequence containing a BirA enzymatic biotinylation site. The heavy chain, β2-microglobulin, and peptide are refolded by dilution. The 45-kD refolded product is isolated by fast protein liquid chromatography and then biotinylated by BirA in the presence of biotin (Sigma, St. Louis, Mo.), adenosine 5' triphosphate and magnesium. Streptavidin-phycoerythrin conjugate is added in a 1:4 molar ratio, and the tetrameric product is concentrated to 1 mg/ml. The resulting product is referred to as tetramer-phycoerythrin.

For the analysis of patient blood samples, approximately one million PBMCs are centrifuged at 300 g for 5 minutes and resuspended in 50 μl of cold phosphate-buffered saline. Tricolor analysis is performed with the tetramer-phycoerythrin, along with anti-CD8-Tricolor, and anti-CD38. The PBMCs are incubated with tetramer and antibodies on ice for 30 to 60 min and then washed twice before formaldehyde fixation. Gates are applied to contain >99.98% of control samples. Controls for the tetramers include both A*0201-negative individuals and A*0201-positive non-diseased donors. The percentage of cells stained with the tetramer is then determined by flow cytometry. The results indicate the number of cells in the PBMC sample that contain epitope-restricted CTLs, thereby readily indicating the extent of immune response to the protein of the invention epitopes, and thus the status of exposure to proteins of the invention, or exposure to a vaccine that elicits a protective or therapeutic response.

Example 27

Use of Peptide Epitopes to Evaluate Recall Responses

The peptide epitopes of the invention are used as reagents to evaluate T cell responses, such as acute or recall responses, in patients. Such an analysis may be performed on patients who have recovered from a protein of the invention-associated disease or who have been vaccinated with a protein of the invention vaccine.

For example, the class I restricted CTL response of persons who have been vaccinated may be analyzed. The vaccine may be any protein of the invention vaccine. PBMC are collected from vaccinated individuals and HLA typed. Appropriate peptide epitopes of the invention that, optimally, bear supermotifs to provide cross-reactivity with multiple HLA supertype family members, are then used for analysis of samples derived from individuals who bear that HLA type.

PBMC from vaccinated individuals are separated on Ficoll-Histopaque density gradients (Sigma Chemical Co., St. Louis, Mo.), washed three times in HBSS (GIBCO Laboratories), resuspended in RPMI-1640 (GIBCO Laboratories) supplemented with L-glutamine (2 mM), penicillin (50 U/ml), streptomycin (50 μg/ml), and Hepes (10 mM) containing 10% heat-inactivated human AB serum (complete RPMI) and plated using microculture formats. A synthetic peptide comprising an epitope of the invention is added at 10 μg/ml to each well and HBV core 128-140 epitope is added at 1 μg/ml to each well as a source of T cell help during the first week of stimulation.

In the microculture format, $4\times10^5$ PBMC are stimulated with peptide in 8 replicate cultures in 96-well round bottom plate in 100 μl/well of complete RPMI. On days 3 and 10, 100 μl of complete RPMI and 20 U/ml final concentration of rIL-2 are added to each well. On day 7 the cultures are transferred into a 96-well flat-bottom plate and restimulated with peptide, rIL-2 and $10^5$ irradiated (3,000 rad) autologous feeder cells. The cultures are tested for cytotoxic activity on day 14. A positive CTL response requires two or more of the eight replicate cultures to display greater than 10% specific $^{51}Cr$ release, based on comparison with non-diseased control subjects as previously described (Rehermann, et al., *Nature Med.* 2:1104, 1108, 1996; Rehermann et al., *J. Clin. Invest.* 97:1655-1665, 1996; and Rehermann et al. *J. Clin. Invest.* 98:1432-1440, 1996).

Target cell lines are autologous and allogeneic EBV-transformed B-LCL that are either purchased from the American Society for Histocompatibility and Immunogenetics (ASHI, Boston, Mass.) or established from the pool of patients as described (Guilhot, et al. *J. Virol.* 66:2670-2678, 1992).

Cytotoxicity assays are performed in the following manner. Target cells consist of either allogeneic HLA-matched or autologous EBV-transformed B lymphoblastoid cell line that are incubated overnight with the synthetic peptide epitope of the invention at 10 μM, and labeled with 100 μCi of $^{51}Cr$ (Amersham Corp., Arlington Heights, Ill.) for 1 hour after which they are washed four times with HBSS.

Cytolytic activity is determined in a standard 4-h, split well $^{51}Cr$ release assay using U-bottomed 96 well plates containing 3,000 targets/well. Stimulated PBMC are tested at effector/target (E/T) ratios of 20-50:1 on day 14. Percent cytotoxicity is determined from the formula: 100×[(experimental release-spontaneous release)/maximum release-spontaneous release)]. Maximum release is determined by lysis of targets by detergent (2% Triton X-100; Sigma Chemical Co., St. Louis, Mo.). Spontaneous release is <25% of maximum release for all experiments.

The results of such an analysis indicate the extent to which HLA-restricted CTL populations have been stimulated by previous exposure to proteins of the invention or a protein of the invention-related vaccine.

Similarly, Class II restricted HTL responses may also be analyzed. Purified PBMC are cultured in a 96-well flat bottom plate at a density of $1.5\times10^5$ cells/well and are stimulated with 10 μg/ml synthetic peptide of the invention, a whole protein of the invention antigens, or PHA. Cells are routinely plated in replicates of 4-6 wells for each condition. After seven days of culture, the medium is removed and replaced with fresh medium containing 10 U/ml IL-2. Two days later, 1 μCi $^3H$-thymidine is added to each well and incubation is continued for an additional 18 hours. Cellular DNA is then harvested on glass fiber mats and analyzed for $^3H$-thymidine incorporation. Antigen-specific T cell proliferation is calculated as the ratio of $^3H$-thymidine incorporation in the presence of antigen divided by the $^3H$-thymidine incorporation in the absence of antigen.

Example 28

Induction of Specific CTL Response in Humans

A human clinical trial for an immunogenic composition comprising CTL and HTL epitopes of the invention is set up as an IND Phase I, dose escalation study and carried out as a randomized, double-blind, placebo-controlled trial. Such a trial is designed, for example, as follows:

A total of about 27 individuals are enrolled and divided into 3 groups:

Group I: 3 subjects are injected with placebo and 6 subjects are injected with 5 μg of peptide composition;

Group II: 3 subjects are injected with placebo and 6 subjects are injected with 50 μg peptide composition;

Group III: 3 subjects are injected with placebo and 6 subjects are injected with 500 μg of peptide composition.

After 4 weeks following the first injection, all subjects receive a booster inoculation at the same dosage.

The endpoints measured in this study relate to the safety and tolerability of the peptide composition as well as its immunogenicity. Cellular immune responses to the peptide composition are an index of the intrinsic activity of this the peptide composition, and can therefore be viewed as a measure of biological efficacy. The following summarize the clinical and laboratory data that relate to safety and efficacy endpoints.

Safety: The incidence of adverse events is monitored in the placebo and drug treatment group and assessed in terms of degree and reversibility.

Evaluation of Vaccine Efficacy: For evaluation of vaccine efficacy, subjects are bled before and after injection. Peripheral blood mononuclear cells are isolated from fresh heparinized blood by Ficoll-Hypaque density gradient centrifugation, aliquoted in freezing media and stored frozen. Samples are assayed for CTL and HTL activity.

The vaccine is found to be both safe and efficacious.

Example 29

Phase II Trials in Patients Expressing a Gene of the Invention

Phase II trials are performed to study the effect of administering the CTL-HTL peptide compositions to patients having a cancer that expresses genes of the invention. The main objectives of the trial are to determine an effective dose and regimen for inducing CTLs in cancer patients that express a gene(s) of the invention, to establish the safety of inducing a CTL and HTL response in these patients, and to see to what extent activation of CTLs improves the clinical picture of these patients, as manifested, e.g., by the reduction and/or shrinking of lesions. Such a study is designed, for example, as follows:

The studies are performed in multiple centers. The trial design is an open-label, uncontrolled, dose escalation protocol wherein the peptide composition is administered as a single dose followed six weeks later by a single booster shot of the same dose. The dosages are 50, 500 and 5,000 micrograms per injection. Drug-associated adverse effects (severity and reversibility) are recorded.

There are three patient groupings. The first group is injected with 50 micrograms of the peptide composition and the second and third groups with 500 and 5,000 micrograms of peptide composition, respectively. The patients within each group range in age from 21-65 and represent diverse ethnic backgrounds. All of them have a tumor that expresses a gene of the invention.

Clinical manifestations or antigen-specific T-cell responses are monitored to assess the effects of administering the peptide compositions. The vaccine composition is found to be both safe and efficacious in the treatment of a gene of the invention-associated disease.

Example 30

Induction of CTL Responses Using a Prime Boost Protocol

A prime boost protocol similar in its underlying principle to that used to confirm the efficacy of a DNA vaccine in transgenic mice, such as described above in the Example entitled "The Plasmid Construct and the Degree to Which It Induces Immunogenicity," can also be used for the administration of the vaccine to humans. Such a vaccine regimen can include an initial administration of, for example, naked DNA followed by a boost using recombinant virus encoding the vaccine, or recombinant protein/polypeptide or a peptide mixture administered in an adjuvant.

For example, the initial immunization may be performed using an expression vector, such as that constructed in the Example entitled "Construction of 'Minigene' Multi-Epitope DNA Plasmids" in the form of naked nucleic acid administered IM (or SC or ID) in the amounts of 0.5-5 mg at multiple sites. The nucleic acid (0.1 to 1000 μg) can also be administered using a gene gun. Following an incubation period of 34 weeks, a booster dose is then administered. The booster can be recombinant fowlpox virus administered at a dose of $5\text{-}10^7$ to $5\times10^9$ pfu. An alternative recombinant virus, such as an MVA, canarypox, adenovirus, or adeno-associated virus, can also be used for the booster, or the polyepitopic protein or a mixture of the peptides can be administered. For evaluation of vaccine efficacy, patient blood samples are obtained before immunization as well as at intervals following administration of the initial vaccine and booster doses of the vaccine. Peripheral blood mononuclear cells are isolated from fresh heparinized blood by Ficoll-Hypaque density gradient centrifugation, aliquoted in freezing media and stored frozen. Samples are assayed for CTL and HTL activity.

Analysis of the results indicates that a magnitude of response sufficient to achieve a therapeutic or protective immunity against of FIG. 2 is generated.

Example 31

Administration of Vaccine Compositions Using Dendritic Cells (DC)

Vaccines comprising peptide epitopes of the invention can be administered using APCs, or "professional" APCs such as DC. In this example, peptide-pulsed DC are administered to a patient to stimulate a CTL response in vivo. In this method, dendritic cells are isolated, expanded, and pulsed with a vaccine comprising peptide CTL and HTL epitopes of the invention. The dendritic cells are infused back into the patient to elicit CTL and HTL responses in vivo. The induced CTL and HTL then destroy or facilitate destruction, respectively, of the target cells that bear the proteins of the invention from which the epitopes in the vaccine are derived.

For example, a cocktail of epitope-comprising peptides is administered ex vivo to PBMC, or isolated DC therefrom. A pharmaceutical to facilitate harvesting of DC can be used, such as Progenipoietin™ (Monsanto, St. Louis, Mo.) or GM-CSF/IL-4. After pulsing the DC with peptides, and prior to reinfusion into patients, the DC are washed to remove unbound peptides.

As appreciated clinically, and readily determined by one of skill based on clinical outcomes, the number of DC reinfused into the patient can vary (see, e.g., *Nature Med.* 4:328, 1998; *Nature Med.* 2:52, 1996 and *Prostate* 32:272, 1997). Although 2-50×$10^6$ DC per patient are typically administered, larger number of DC, such as $10^7$ or $10^8$ can also be provided. Such cell populations typically contain between 50-90% DC.

In some embodiments, peptide-loaded PBMC are injected into patients without purification of the DC. For example, PBMC generated after treatment with an agent such as Progenipoietin™ are injected into patients without purification of the DC. The total number of PBMC that are administered often ranges from $10^8$ to $10^{10}$. Generally, the cell doses injected into patients is based on the percentage of DC in the blood of each patient, as determined, for example, by immunofluorescence analysis with specific anti-DC antibodies. Thus, for example, if Progenipoietin™ mobilizes 2% DC in the peripheral blood of a given patient, and that patient is to receive 5×$10^6$ DC, then the patient will be injected with a total of 2.5×$10^8$ peptide-loaded PBMC. The percent DC mobilized by an agent such as Progenipoietin™ is typically estimated to be between 2-10%, but can vary as appreciated by one of skill in the art.

Ex Vivo Activation of CTL/HTL Responses

Alternatively, ex vivo CTL or HTL responses to protein antigens of the invention can be induced by incubating, in tissue culture, the patient's, or genetically compatible, CTL or HTL precursor cells together with a source of APC, such as DC, and immunogenic peptides. After an appropriate incubation time (typically about 7-28 days), in which the precursor cells are activated and expanded into effector cells, the cells are infused into the patient, where they will destroy (CTL) or facilitate destruction (HTL) of their specific target cells, i.e., tumor cells.

Example 32

An Alternative Method of Identifying Motif-Bearing Peptides

Another method of identifying and confirming motif-bearing peptides is to elute them from cells bearing defined MHC molecules. For example, EBV transformed B cell lines used for tissue typing have been extensively characterized to determine which HLA molecules they express. In certain cases these cells express only a single type of HLA molecule. These cells can be transfected with nucleic acids that express the antigens of interest, e.g. antigens of FIG. 2. Peptides produced by endogenous antigen processing of peptides produced as a result of transfection will then bind to HLA molecules within the cell and be transported and displayed on the cell's surface. Peptides are then eluted from the HLA molecules by exposure to mild acid conditions and their amino acid sequence determined, e.g., by mass spectral analysis (e.g., Kubo et al., *J. Immunol.* 152:3913, 1994). Because the majority of peptides that bind a particular HLA molecule are motif-bearing, this is an alternative modality for obtaining the motif-bearing peptides correlated with the particular HLA molecule expressed on the cell.

Alternatively, cell lines that do not express endogenous HLA molecules can be transfected with an expression construct encoding a single HLA allele. These cells can then be used as described, i.e., they can then be transfected with nucleic acids that encode proteins of the invention, to isolate peptides corresponding to proteins of FIG. 2 that have been presented on the cell surface. Peptides obtained from such an analysis will bear motif(s) that correspond to binding to the single HLA allele that is expressed in the cell.

As appreciated by one in the art, one can perform a similar analysis on a cell bearing more than one HLA allele and subsequently determine peptides specific for each HLA allele expressed. Moreover, one of skill would also recognize that means other than transfection, such as loading with a protein antigen, can be used to provide a source of antigen to the cell.

Example 33

Complementary Polynucleotides

Sequences complementary to FIG. 2 protein-encoding sequences, or any parts thereof, are used to detect, decrease, or inhibit expression of naturally occurring proteins of the invention. Although use of oligonucleotides comprising from about 15 to 30 base pairs is described, essentially the same procedure is used with smaller or with larger sequence fragments. Appropriate oligonucleotides are designed using, e.g., OLIGO 4.06 software (National Biosciences) and the coding sequences of proteins of the invention. To inhibit transcription, a complementary oligonucleotide is designed from the most unique 5' sequence and used to prevent promoter binding to the coding sequence. To inhibit translation, a complementary oligonucleotide is designed to prevent ribosomal binding to a FIG. 2 protein-encoding transcript.

Example 34

Purification of Naturally-Occurring or Recombinant FIG. 2 Proteins Using Specific Antibodies Naturally occurring or recombinant FIG. 2 proteins are substantially purified by immunoaffinity chromatography using antibodies specific for a protein of the invention. An immunoaffinity column is constructed by covalently coupling, e.g., anti-protein of FIG. 2 antibodies to an activated chromatographic resin, such as CNBr-activated SEPHAROSE (Amersham Pharmacia Biotech). After the coupling, the resin is blocked and washed according to the manufacturer's instructions.

Media containing protein(s) of the invention are passed over the immunoaffinity column, and the column is washed under conditions that allow the preferential absorbance of proteins of the invention (e.g., high ionic strength buffers in the presence of detergent). The column is eluted under conditions that disrupt antibody/FIG. 2 protein binding (e.g., a buffer of pH 2 to pH 3, or a high concentration of a chaotrope, such as urea or thiocyanate ion), and GCR.P is collected.

Example 35

Identification of Molecules which Interact with Proteins of the Invention

FIG. 2 proteins, or biologically active fragments thereof, are labeled with 121 1 Bolton-Hunter reagent. (See, e.g., Bolton et al. (1973) Biochem. J. 133:529.) Candidate molecules previously arrayed in the wells of a multi-well plate are incubated with the labeled FIG. 2 proteins, washed, and any wells with labeled FIG. 2 protein complexes are assayed. Data obtained using different concentrations of FIG. 2 proteins are used to calculate values for the number, affinity, and association of FIG. 2 proteins with the candidate molecules.

Example 36

In Vivo Assay for Tumor Growth Promotion

The effect of a FIG. 2 protein on tumor cell growth is evaluated in vivo by gene overexpression in tumor-bearing mice. For example, SCID mice are injected subcutaneously on each flank with $1\times10^6$ of either PC3, DU145 or 3T3 cells containing tkNeo empty vector or a nucleic acid sequence of the invention. At least two strategies can be used: (1) Constitutive expression under regulation of a promoter such as a constitutive promoter obtained from the genomes of viruses such as polyoma virus, fowlpox virus (UK 2,211,504 published 5 Jul. 1989), adenovirus (such as Adenovirus 2), bovine papilloma virus, avian sarcoma virus, cytomegalovirus, a retrovirus, hepatitis-B virus and Simian Virus 40 (SV40), or from heterologous mammalian promoters, e.g., the actin promoter or an immunoglobulin promoter, provided such promoters are compatible with the host cell systems, and (2) Regulated expression under control of an inducible vector system, such as ecdysone, tet, etc., provided such promoters are compatible with the host cell systems. Tumor volume is then monitored at the appearance of palpable tumors and followed over time to determine if the cells expressing a gene of the invention grow at a faster rate and whether tumors of a FIG. 2 protein-expressing cells demonstrate characteristics of altered aggressiveness (e.g. enhanced metastasis, vascularization, reduced responsiveness to chemotherapeutic drugs).

Additionally, mice can be implanted with $1\times10^5$ of the same cells orthotopically to determine if a protein of the invention has an effect on local growth in the prostate or on the ability of the cells to metastasize, specifically to lungs, lymph nodes, and bone marrow.

The assay is also useful to determine the inhibitory effect of candidate therapeutic compositions, such as for example, FIG. 2 protein-related intrabodies, FIG. 2 gene-related antisense molecules and ribozymes.

Example 37

Tumors In Vivo, with Monoclonals Specific to a FIG. 2 Protein

The significant expression of a FIG. 2 proteins in cancer tissues of Table I and its restrictive expression in normal tissues, together with its expected cell surface expression, makes FIG. 2 proteins excellent targets for antibody therapy. Similarly, FIG. 2 proteins are a target for T cell-based immunotherapy. Thus, for FIG. 2 genes expressed, e.g., in prostate cancer, the therapeutic efficacy of anti-FIG. 2 protein mAbs in human prostate cancer xenograft mouse models is evaluated by using androgen-independent LAPC-4 and LAPC-9 xenografts (Craft, N., et al., Cancer Res, 1999. 59(19): p. 5030-6) and the androgen independent recombinant cell line PC3- of FIG. 2 (see, e.g., Kaighn, M. E., et al., Invest Urol, 1979. 17(1): p. 16-23); analogous models are used for other cancers.

Antibody efficacy on tumor growth and metastasis formation is studied, e.g., in a mouse orthotopic prostate cancer xenograft models and mouse kidney xenograft models. The antibodies can be unconjugated, as discussed in this Example, or can be conjugated to a therapeutic modality, as appreciated in the art. Anti-FIG. 2 protein mAbs inhibit formation of both the androgen-dependent LAPC-9 and androgen-independent PC3-FIG. 2 protein tumor xenografts. Anti-FIG. 2 protein mAbs also retard the growth of established orthotopic tumors and prolonged survival of tumor-bearing mice. These results indicate the utility of anti-FIG. 2 protein mAbs in the treatment of local and advanced stages of prostate cancer. (See, e.g., Saffran, D., et al., PNAS 10:1073-1078.)

Administration of the anti-FIG. 2 protein mAbs lead to retardation of established orthotopic tumor growth and inhibition of metastasis to distant sites, resulting in a significant prolongation in the survival of tumor-bearing mice. These studies indicate that proteins of the invention are attractive targets for immunotherapy and demonstrate the therapeutic potential of anti-FIG. 2 protein mAbs for the treatment of local and metastatic cancer. This example demonstrates that unconjugated FIG. 2 protein-related monoclonal antibodies are effective to inhibit the growth of human prostate tumor xenografts and human kidney xenografts grown in SCID mice; accordingly a combination of such efficacious monoclonal antibodies is also effective.

Tumor Inhibition Using Multiple Unconjugated mAbs

Materials and Methods

FIG. 2 Protein-Related Monoclonal Antibodies:

Monoclonal antibodies are raised against proteins of the invention as described in Example 10. The antibodies are characterized by ELISA, Western blot, FACS, and immunoprecipitation for their capacity to bind to the respective protein of the invention. Epitope mapping data for, e.g., the anti-FIG. 2 protein mAbs, as determined by ELISA and Western analysis, indicate that the antibodies recognize epitopes on the respective FIG. 2 protein. Immunohistochemical analysis of prostate cancer tissues and cells with these antibodies is performed.

The monoclonal antibodies are purified from ascites or hybridoma tissue culture supernatants by Protein-G Sepharose chromatography, dialyzed against PBS, filter sterilized, and stored at −20° C. Protein determinations are performed by a Bradford assay (Bio-Rad, Hercules, Calif.). A therapeutic monoclonal antibody or a cocktail comprising a mixture of individual monoclonal antibodies is prepared and used for the treatment of mice receiving subcutaneous or orthotopic injections of LAPC-9 prostate tumor xenografts.

Cancer Xenografts and Cell Lines

The LAPC-9 xenograft, which expresses a wild-type androgen receptor and produces prostate-specific antigen (PSA), is passaged in 6- to 8-week-old male ICR-severe combined immunodeficient (SCID) mice (Taconic Farms) by s.c. trocar implant (Craft, N., et al., supra). The prostate carcinoma cell line PC3 (American Type Culture Collection) is maintained in RPMI supplemented with L-glutamine and 10% FBS.

Recombinant PC3 and 3T3-cell populations expressing a protein of the invention are generated by retroviral gene transfer as described in Hubert, R. S., et al., STEAP: a prostate-specific cell-surface antigen highly expressed in human prostate tumors. Proc Natl Acad Sci USA, 1999. 96(25): p. 14523-8. Anti-protein of the invention staining is detected by using an FITC-conjugated goat anti-mouse antibody (Southern Biotechnology Associates) followed by analysis on a Coulter Epics-XL flow cytometer.

Xenograft Mouse Models.

Subcutaneous (s.c.) tumors are generated by injection of $1\times10^6$ LAPC-9, PC3, recombinant PC3-protein of the invention, 3T3 or recombinant 3T3-protein of the invention cells mixed at a 1:1 dilution with Matrigel (Collaborative Research) in the right flank of male SCID mice. To test antibody efficacy on tumor formation, i.p. antibody injections are started on the same day as tumor-cell injections. As a control, mice are injected with either purified mouse IgG (ICN) or PBS; or a purified monoclonal antibody that recognizes an irrelevant antigen not expressed in human cells. In preliminary studies, no difference is found between mouse IgG or PBS on tumor growth. Tumor sizes are determined by vernier caliper measurements, and the tumor volume is calculated as length×width×height. Mice with s.c. tumors greater than 1.5 cm in diameter are sacrificed. PSA levels are determined by using a PSA ELISA kit (Anogen, Mississauga, Ontario). Circulating levels of, e.g., anti-FIG. 2 protein mAbs are determined by a capture ELISA kit (Bethyl Laboratories, Montgomery, Tex.). (See, e.g., Saffran, D., et al., PNAS 10:1073-1078.)

Orthotopic injections are performed under anesthesia by using ketamine/xylazine. For prostate orthotopic studies, an incision is made through the abdominal muscles to expose the bladder and seminal vesicles, which then are delivered through the incision to expose the dorsal prostate. LAPC-9 or PC3 cells ($5\times10^5$) mixed with Matrigel are injected into each dorsal lobe in a 10-μl volume. To monitor tumor growth, mice are bled on a weekly basis for determination of PSA levels. The mice are segregated into groups for the appropriate treatments, with anti-protein of the invention or control mAbs being injected i.p.

Anti-FIG. 2 Protein mAbs Inhibit Growth of Respective FIG. 2 Protein-Expressing Xenograft-Cancer Tumors The effect of anti-FIG. 2 protein mAbs on tumor formation is tested by using LAPC-9 and recombinant PC3-protein of the invention orthotopic models. As compared with the s.c. tumor model, the orthotopic model, which requires injection of tumor cells directly in the mouse prostate or kidney, respectively, results in a local tumor growth, development of metastasis in distal sites, deterioration of mouse health, and subsequent death (Saffran, D., et al., PNAS supra; Fu, X., et al., Int J Cancer, 1992. 52(6): p. 987-90; Kubota, T., J Cell Biochem, 1994. 56(1): p. 4-8). The features make the orthotopic model more representative of human disease progression and allowed us to follow the therapeutic effect of mAbs on clinically relevant end points.

Accordingly, tumor cells are injected into the mouse prostate or kidney, and 2 days later, the mice are segregated into two groups and treated with either: a) 200-500 μg, of anti-FIG. 2 protein Ab, or b) PBS three times per week for two to five weeks.

A major advantage of the orthotopic prostate-cancer model is the ability to study the development of metastases. Formation of metastasis in mice bearing established orthotopic tumors is studied by IHC analysis on lung sections using an antibody against a prostate-specific cell-surface protein STEAP expressed at high levels in LAPC-9 xenografts (Hubert, R. S., et al., Proc Natl Acad Sci USA, 1999. 96(25): p. 14523-8).

Mice bearing established orthotopic LAPC-9 or recombinant PC3-FIG. 2 protein tumors are administered 1000 μg injections of either anti-FIG. 2 protein mAbs or PBS over a 4-week period. Mice in both groups are allowed to establish a high tumor burden (PSA levels greater than 300 ng/ml for IAPC-9), to ensure a high frequency of metastasis formation in mouse lungs. Mice then are killed and their prostate and lungs are analyzed for the presence of tumor cells by IHC analysis.

These studies demonstrate a broad anti-tumor efficacy of anti-FIG. 2 protein antibodies on initiation and progression of prostate cancer in xenograft mouse models. Anti-FIG. 2 protein antibodies inhibit tumor formation of both androgen-dependent and androgen-independent tumors, retard the growth of already established tumors, and prolong the survival of treated mice. Moreover, anti-FIG. 2 protein mAbs demonstrate a dramatic inhibitory effect on the spread of local prostate tumor to distal sites, even in the presence of a large tumor burden. Thus, anti-FIG. 2 protein mAbs are efficacious on major clinically relevant end points (tumor growth), prolongation of survival, and health.

Example 38

Therapeutic and Diagnostic Use of Antibodies Specific to a Protein of FIG. 2

Anti-protein of FIG. 2 monoclonal antibodies are safely and effectively used for diagnostic, prophylactic, prognostic and/or therapeutic purposes in humans. Western blot and immunohistochemical analysis of cancer tissues and cancer xenografts with anti-protein of FIG. 2 mAb show strong extensive staining in carcinoma but significantly lower or undetectable levels in normal tissues. Detection of a protein of FIG. 2 in carcinoma and in metastatic disease demonstrates the usefulness of the mAb as a diagnostic and/or prognostic indicator. Anti-protein of FIG. 2 antibodies are therefore used in diagnostic applications such as immunohistochemistry of biopsy specimens to detect cancer from suspect patients.

As determined by flow cytometry, anti-protein of FIG. 2 mAbs specifically bind to carcinoma cells. Thus, anti-protein of FIG. 2 antibodies are used in diagnostic whole body imaging applications, such as radioimmunoscintigraphy and radioimmunotherapy, (see, e.g., Potamianos S., et. al. Anticancer Res 20(2A):925-948 (2000)) for the detection of localized and metastatic cancers that exhibit expression of a protein of FIG. 2. Shedding or release of an extracellular domain of a protein of FIG. 2 into the extracellular milieu, such as that seen for alkaline phosphodiesterase B10 (Meerson, N. R., Hepatology 27:563-568 (1998)), allows diagnostic detection of a protein of FIG. 2 by corresponding anti-protein of FIG. 2 antibodies in serum and/or urine samples from suspect patients.

Anti-protein of FIG. 2 antibodies that specifically bind protein of FIG. 2 are used in therapeutic applications for the treatment of cancers that express that protein of FIG. 2. Anti-protein of FIG. 2 antibodies are used as an unconjugated modality and as a conjugated form in which the antibodies are attached to one of various therapeutic or imaging modalities well known in the art, such as a prodrugs, enzymes or radioisotopes. In preclinical studies, unconjugated and conjugated anti-protein of FIG. 2 antibodies are tested for efficacy of tumor prevention and growth inhibition in the SCID mouse cancer xenograft models, e.g., kidney cancer models AGS-K3 and AGS-K6, (see, e.g., the Example entitled "Monoclonal Antibody-mediated Inhibition of Prostate Tumors In vivo"). Conjugated and unconjugated anti-protein of FIG. 2 antibodies are used as a therapeutic modality in human clinical trials either alone or in combination with other treatments as described in the following Examples.

Example 39

Human Clinical Trials for the Treatment and Diagnosis of Human Carcinomas Through Use of Human Antibodies Specific for a Protein of FIG. 2 In Vivo Antibodies are used in accordance with the present invention which recognize an epitope of a FIG. 2 protein, and are used in the treatment of certain tumors such as those listed in Table I. Based upon a number of factors, including FIG. 2 protein expression levels, tumors such as those listed in Table I are presently preferred indications. In connection with each of these indications, three clinical approaches are successfully pursued.

I.) Adjunctive therapy: In adjunctive therapy, patients are treated with antibodies of the invention, e.g., antibodies that specifically bind a protein of the invention, in combination with a chemotherapeutic or antineoplastic agent and/or radiation therapy. Primary cancer targets, such as those listed in Table I, are treated under standard protocols by the addition anti-FIG. 2 protein antibodies to standard first and second line therapy. Protocol designs address effectiveness as assessed by reduction in tumor mass as well as the ability to reduce usual doses of standard chemotherapy. These dosage reductions allow additional and/or prolonged therapy by reducing dose-related toxicity of the chemotherapeutic agent. Anti-FIG. 2 protein antibodies are utilized in several adjunctive clinical trials in combination with the chemotherapeutic or antineoplastic agents adriamycin (advanced prostrate carcinoma), cisplatin (advanced head and neck and lung carcinomas), taxol (breast cancer), and doxorubicin (preclinical).

II.) Monotherapy: In connection with the use of the anti-FIG. 2 protein antibodies in monotherapy of tumors, the antibodies are administered to patients without a chemotherapeutic or antineoplastic agent. In one embodiment, monotherapy is conducted clinically in end stage cancer patients with extensive metastatic disease. Patients show some disease stabilization. Trials demonstrate an effect in refractory patients with cancerous tumors.

III.) Imaging Agent: Through binding a radionuclide (e.g., iodine or yttrium ($I^{131}$, $Y^{90}$) to anti-FIG. 2 protein antibodies, the radiolabeled antibodies are utilized as a diagnostic and/or imaging agent. In such a role, the labeled antibodies localize to both solid tumors, as well as, metastatic lesions of cells expressing a protein of the invention. In connection with the use of the anti-FIG. 2 protein antibodies as imaging agents, the antibodies are used as an adjunct to surgical treatment of solid tumors, as both a pre-surgical screen as well as a post-operative follow-up to determine what tumor remains and/or returns. In one embodiment, a ($^{111}In$)-FIG. 2 protein antibody is used as an imaging agent in a Phase I human clinical trial in patients having a carcinoma that expresses a protein of the invention (by analogy see, e.g., Divgi et al. *J. Natl. Cancer Inst.* 83:97-104 (1991)). Patients are followed with standard anterior and posterior gamma camera. The results indicate that primary lesions and metastatic lesions are identified Dose and Route of Administration As appreciated by those of ordinary skill in the art, dosing considerations can be determined through comparison with the analogous products that are in the clinic. Thus, anti-FIG. 2 protein antibodies can be administered with doses in the range of 5 to 400 $mg/m^2$, with the lower doses used, e.g., in connection with safety studies. The affinity of anti-FIG. 2 protein antibodies relative to the affinity of a known antibody for its target is one parameter used by those of skill in the art for determining analogous dose regimens. Further, anti-FIG. 2 protein antibodies that are fully human antibodies, as compared to the chimeric antibody, have slower clearance; accordingly, dosing in patients with such fully human anti-FIG. 2 protein antibodies can be lower, perhaps in the range of 50 to 300 $mg/m^2$, and still remain efficacious. Dosing in $mg/m^2$, as opposed to the conventional measurement of dose in mg/kg, is a measurement based on surface area and is a convenient dosing measurement that is designed to include patients of all sizes from infants to adults. Three distinct delivery approaches are useful for delivery of anti-FIG. 2 protein antibodies. Conventional intravenous delivery is one standard delivery technique for many tumors. However, in connection with tumors in the peritoneal cavity, such as tumors of the ovaries, biliary duct, other ducts, and the like, intraperitoneal administration may prove favorable for obtaining high dose of antibody at the tumor and to also minimize antibody clearance. In a similar manner, certain solid tumors possess vasculature that is appropriate for regional perfusion. Regional perfusion allows for a high dose of antibody at the site of a tumor and minimizes short term clearance of the antibody.

Clinical Development Plan (CDP)

Overview: The CDP follows and develops treatments of anti-FIG. 2 protein antibodies in connection with adjunctive therapy, monotherapy, and as an imaging agent. Trials initially demonstrate safety and thereafter confirm efficacy in repeat doses. Trials are open label comparing standard chemotherapy with standard therapy plus anti-FIG. 2 protein antibodies. As will be appreciated, one criteria that can be utilized in connection with enrollment of patients is FIG. 2 protein expression levels in their tumors as determined e.g. from biopsy specimens. As with any protein or antibody infusion-based therapeutic, safety concerns are related primarily to (i) cytokine release syndrome, i.e., hypotension, fever, shaking, chills; (ii) the development of an immunogenic response to the material (i.e., development of human antibodies by the patient to the antibody therapeutic, or HAHA response); and, (iii) toxicity to normal cells that express a protein of the invention. Standard tests and follow-ups are utilized to monitor each of these safety concerns. Anti-FIG. 2 protein antibodies are found to be safe upon human administration.

Example 40

Human Clinical Trial Adjunctive Therapy with Human Antibody (Specific to a Protein of FIG. 2) and Chemotherapeutic Agent A phase I human clinical trial is initiated to assess the safety of six intravenous doses of a human anti-FIG. 2 protein antibody in connection with the treatment of a solid tumor, e.g., a cancer of a tissue listed in Table I. In the study, the safety of single doses of anti-FIG. 2 protein antibodies when utilized as an adjunctive therapy to an antineoplastic or chemotherapeutic agent, such as cisplatin, topotecan, doxorubicin, adriamycin, taxol, or the like, is assessed. The trial design includes delivery of six single doses of an anti-FIG. 2 protein antibody with dosage of antibody escalating from approximately about 25 $mg/m^2$ to about 275 $mg/m^2$ over the course of the treatment in accordance with the following schedule:

| | Day 0 | Day 7 | Day 14 | Day 21 | Day 28 | Day 35 |
|---|---|---|---|---|---|---|
| mAb Dose | 25 $mg/m^2$ | 75 $mg/m^2$ | 125 $mg/m^2$ | 175 $mg/m^2$ | 225 $mg/m^2$ | 275 $mg/m^2$ |
| Chemotherapy (standard dose) | + | + | + | + | + | + |

Patients are closely followed for one-week following each administration of antibody and chemotherapy. In particular, patients are assessed for the safety concerns mentioned above: (i) cytokine release syndrome, i.e., hypotension, fever, shaking, chills; (ii) the development of an immunogenic response to the material (i.e., development of human antibodies by the patient to the human antibody therapeutic, or HAHA response); and, (iii) toxicity to normal cells that express a protein of the invention. Standard tests and follow-up are utilized to monitor each of these safety concerns. Patients are also assessed for clinical outcome, and particularly reduction in tumor mass as evidenced by MRI or other imaging.

The anti-FIG. 2 protein antibodies are demonstrated to be safe and efficacious, Phase II trials confirm the efficacy and refine optimum dosing.

Example 41

Human Clinical Trial: Monotherapy with Human Antibody Specific to a Protein of FIG. 2

Anti-FIG. 2 protein antibodies are safe in connection with the above-discussed adjunctive trial, a Phase II human clinical trial confirms the efficacy and optimum dosing for monotherapy. Such trial is accomplished, and entails the same safety and outcome analyses, to the above-described adjunctive trial with the exception being that patients do not receive chemotherapy concurrently with the receipt of doses of anti-FIG. 2 protein antibodies.

Example 42

Human Clinical Trial: Diagnostic Imaging with Antibody Specific to a Protein of FIG. 2

Once again, as the adjunctive therapy discussed above is safe within the safety criteria discussed above, a human clinical trial is conducted concerning the use of anti-FIG. 2 protein antibodies as a diagnostic imaging agent. The protocol is designed in a substantially similar manner to those described in the art, such as in Divgi et al *J. Natl. Cancer Inst.* 83:97-104 (1991). The antibodies are found to be both safe and efficacious when used as a diagnostic modality.

Example 43

Effects on Tumor Growth and Promotion

The genes in FIG. 2 contribute to the growth of cancer cells. The role of these genes in tumor growth is investigated in a variety of primary and transfected cell lines including prostate, colon, bladder and kidney cell lines as well as NIH 3T3 cells engineered to stably express the gene of interest. Parental cells lacking the gene of interest and cells expressing that gene are evaluated for cell growth using a well-documented proliferation assay (Fraser S P, Grimes J A, Djamgoz M B. Prostate. 2000; 44:61, Johnson D E, Ochieng J, Evans S L. Anticancer Drugs. 1996, 7:288).

To determine the role of genes in FIG. 2 in the transformation process, the effect of individual genes in colony forming assays is investigated. Parental NIH3T3 cells lacking the gene of interest are compared to NHI-3T3 cells expressing that gene, using a soft agar assay under stringent and more permissive conditions (Song Z. et al. Cancer Res. 2000; 60:6730). It is found that genes set forth in FIG. 2 asversely affect transformation.

To determine the role of the genes of FIG. 2 in invasion and metastasis of cancer cells, a well-established assay is used, e.g., a Transwell Insert System assay (Becton Dickinson) (Cancer Res. 1999; 59:6010). Control cells, including prostate, colon, bladder and kidney cell lines lacking the gene of interest are compared to cells expressing that gene. Cells are loaded with the fluorescent dye, calcein, and plated in the top well of the Transwell insert coated with a basement membrane analog. Invasion is determined by fluorescence of cells in the lower chamber relative to the fluorescence of the entire cell population. It is found that genes set forth in FIG. 2 adversely invasion and/or metastasis.

The genes in FIG. 2 also play a role in cell cycle modulation and apoptosis. Parental cells and cells expressing the gene of interest are compared for differences in cell cycle regulation using a well-established BrdU assay (Abdel-Malek Z A. J Cell Physiol. 1988, 136:247). In short, cells are grown under both optimal (full serum) and limiting (low serum) conditions are labeled with BrdU and stained with anti-BrdU Ab and propidium iodide. Cells are analyzed for entry into the G1, S, and G2M phases of the cell cycle. Alternatively, the effect of stress on apoptosis is evaluated in control parental cells and cells expressing the gene of interest, including normal and tumor prostate, colon and lung cells. Engineered and parental cells are treated with various chemotherapeutic agents, such as etoposide, flutamide, etc, and protein synthesis inhibitors, such as cycloheximide. Cells are stained with annexin V-FITC and cell death is measured by FACS analysis. The modulation of cell death by genes of FIG. 2 play a critical role in regulating tumor progression and tumor load.

When a genes set for in FIG. 2, and/or its respective gene product, plays a role in cell growth, transformation, invasion or apoptosis, it is used as a target for diagnostic, prognostic, preventative and therapeutic purposes.

The present invention is not to be limited in scope by the embodiments disclosed herein, which are intended as single illustrations of individual aspects of the invention, and any that are functionally equivalent are within the scope of the invention. Various modifications to the models and methods of the invention, in addition to those described herein, will become apparent to those skilled in the art from the foregoing description and teachings, and are similarly intended to fall within the scope of the invention. Such modifications or other embodiments can be practiced without departing from the true scope and spirit of the invention.

TABLES

Lengthy table referenced here

US07628989-20091208-T00001

Please refer to the end of the specification for access instructions.

Lengthy table referenced here

US07628989-20091208-T00002

Please refer to the end of the specification for access instructions.

Lengthy table referenced here

US07628989-20091208-T00003

Please refer to the end of the specification for access instructions.

Lengthy table referenced here

US07628989-20091208-T00004

Please refer to the end of the specification for access instructions.

Lengthy table referenced here

US07628989-20091208-T00005

Please refer to the end of the specification for access instructions.

Lengthy table referenced here

US07628989-20091208-T00006

Please refer to the end of the specification for access instructions.

Lengthy table referenced here

US07628989-20091208-T00007

Please refer to the end of the specification for access instructions.

Lengthy table referenced here

US07628989-20091208-T00008

Please refer to the end of the specification for access instructions.

Lengthy table referenced here

US07628989-20091208-T00009

Please refer to the end of the specification for access instructions.

Lengthy table referenced here

US07628989-20091208-T00010

Please refer to the end of the specification for access instructions.

Lengthy table referenced here

US07628989-20091208-T00011

Please refer to the end of the specification for access instructions.

Lengthy table referenced here

US07628989-20091208-T00012

Please refer to the end of the specification for access instructions.

Lengthy table referenced here

US07628989-20091208-T00013

Please refer to the end of the specification for access instructions.

Lengthy table referenced here

US07628989-20091208-T00014

Please refer to the end of the specification for access instructions.

Lengthy table referenced here

US07628989-20091208-T00015

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US07628989B2). An electronic copy of the table will also be available from the USPTO upon request and payment of the fee set forth in 37 CFR 1.19(b)(3).

SEQUENCE LISTING (708 sequences)

SEQ ID NO: 1 - DNA, 217 bp, Homo sapiens
gatcatccggagtggccgcctccaataaagcaatgtagcttggagccttggaggtctgaatctcaaatttgccctgtttcacgaatgaatgaattgtggcctcaggaaccacgagcgcatggtgtagcaccagtacaacataaggctgcactgccatctaatgttaatgaatcgccattacagtttactattcggcaggctagattagccggagatc

SEQ ID NO: 2 - DNA, 398 bp, Homo sapiens
  misc_feature 255: n = a, t, c, or g
  misc_feature 295: n = a, t, c, or g
  misc_feature 309: n = a, t, c, or g
  misc_feature 343: n = a, t, c, or g
  misc_feature 352: n = a, t, c, or g
gatcaagcacctggtcctgaaatctttgtattcttgttacagacagaagaagagcaatgctgaagggacttaagttattattggaatctccttgctgtcctacctttaagtgtttcacgagttctctgcctagttcatagtccaatttgatggcaaacacaatgtgtagaataatggtgccttccacatgacgaagttcacctgatggcacagtgacaacatccaatagctcgtcaccactctgttcctcattgngctgcttatctagtgcactgaagaaggctatgattccttncaaaacactctttntgcttccttggaggagagaaccagaagctgatanaccaaaggnggtatttcttgaagattcatcttggagaacaagctcaatgcttttt

SEQ ID NO: 3 - DNA, 192 bp, Homo sapiens
gatcctggttgcagctgttgctggcaccataactgtcgttgtagttattttcatcactgctgtagtaagatgtcgccaggcacacaccttaaggctgctcagaaaaacatgcagaattctgaatgggctaccccaaacccagaaaacaggcagatgataaaaaaaaaaaaaaaaaaaaaaaaaagcttgatc

SEQ ID NO: 4 - DNA, 237 bp, Homo sapiens
gatcttggaccagaagtgtctagcacaacacaatcctgaggcacagtctgatgaccggagacaaacagaaccttcttgtcctttggtgtgatacatttttgaagacaaggtggttcttctggaatacccatccaaggtgctatgatcacggggcccttgtggaataaaggccggtggttctcctcatgcttgtccaggcagttgggatgcacagcatgggccatgtctgcgctgatc

SEQ ID NO: 5 - DNA, 265 bp, Homo sapiens
  misc_feature 6: n = a, t, c, or g
  misc_feature 178: n = a, t, c, or g
  misc_feature 184: n = a, t, c, or g
  misc_feature 228: n = a, t, c, or g
  misc_feature 234: n = a, t, c, or g
  misc_feature 239: n = a, t, c, or g
  misc_feature (241)...(256): n = a, t, c, or g at positions 241, 250, 252, 256.
gatctncccgccgcagcctcctcagaagacatcgagcggtcctgagagcctcctgggcacgtttgtctgtgtgctgtaacctgaagtcaaaccttaagataatggataatcttcggccaatttatgcagagtcagccattcctgttctctttgccttgatgttgtgttgttatcattnaagatnttttttatggtaattattttgagtggcaaaataaagaatagcanttaaanaaaananaaaaaaaananaaancgcttgatc

SEQ ID NO: 6 - DNA, 267 bp, Homo sapiens
gatccaggcaaacattacacgcagacaagaaaagtgtaatttctttgcagtaatataggattttttgtgcagattcatctaaaagcctgtctaagtgactaaaagtaaaaggaattctgcacaagtgatatggtagaaagcaggtaaaaaacacagccacaacaaccctgatgctctggttatgttttcgctttcggcttgactgacttatgaattgcctgctggatttgtggatgtacctggatatggctatgtaacatcccgatc

SEQ ID NO: 7 - DNA, 212 bp, Homo sapiens
gatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatc

SEQ ID NO: 8 - DNA, 199 bp, Homo sapiens
  misc_feature 193: n = a, t, c, or g
gatctctttctgtgtgtattggtcagaatagaatccattcagctgtagcagcaagcaatccccaacctttcactgcaatgacctttcaatgcaataaaagcttattgtccattcaaaaaaaaaaaaaaaaaaaaaaaaaaaaaaaaaaaaaaaaaaaaaaaaaaaaaaaaaaaaaaaaaaaaaaaaaaaaggnttgatc

SEQ ID NO: 9 - DNA, 110 bp, Homo sapiens
  misc_feature 19: n = a, t, c, or g
  misc_feature 25: n = a, t, c, or g
  misc_feature 28: n = a, t, c, or g
  misc_feature 31: n = a, t, c, or g
  misc_feature 46: n = a, t, c, or g
  misc_feature 86: n = a, t, c, or g
  misc_feature 93: n = a, t, c, or g
gatccttggccctctaggnaagtangtnagngccccaagactgganctggtctctttcaacgccttgggagactgggtgaaaggcnagcttgnttacgcttaaaatgatc

SEQ ID NO: 10 - DNA, 65 bp, Homo sapiens
gatcaattgaatgaaaatatcgtttcaaaaaacaaaaaaaaaaaaaaaaaaaaaaaggcttgatc

SEQ ID NO: 11 - DNA, 365 bp, Homo sapiens
gatcttaactttgcatggagaacagaatgctgtgtgtgagtgcgtgggtgagtgagggtttgacacacacaccagccacactcccacccccatctatgagggcacacaccacaccccacatcccggcaccccatttctcatgctttaagtggaagcatcttcgcagcacgaaccacaggtcccttggaaggagagtctgaggtctttgccttttttgcagtcgcattgcatttatactcagggaggaaaaaaaaatatatcaccaggcacaaagggaggaggggcggggagaggaaggagcgggaagggaggaggagaggccgcgctctcaggtgaaattaaaattggaggtcagttcccggatc

SEQ ID NO: 12 - DNA, 296 bp, Homo sapiens
gatcatcaagttgtatagctgtatcattggcaacatgatttcgctgtttcagatagagagccttgcccgggaggcctccactggagtactaaaagacctaatgcatggcctcatcaccttaatgctggattctcggattgaagatcattccagccccagtgctgttctctgaattcttggggaacacagggatgggggctcctaatgaggaccccagaaactctgagctctcacaactttcaaaggacacttgcctccctcctctgcccacacctccaccattacagcatttgatc

SEQ ID NO: 13 - DNA, 406 bp, Homo sapiens
gatctctgaactcctgggctgaggatgatttgctccctgctgtagaatctgccattccttcccttagctggttcagaaggtctctgctctcactgggaggcaagttactcaggaagtatggaggggccaattccaccagcatctgtggttgaatctcagaaacaatggaaaggcagttgtctttggatatggtgaaattgtggtagagcacccatggtgggggtctggcaggagctctgcggcttcggtagcagcagtatgaggagagctgggccacatgcttatgggttaggagaaggtaatttccagtcccgtctgtgtctctggccaccttgagaaagtatcctgacaccagtgctttctgaaggtctctgcgattctgctcagagccaaaggctggtaggga

SEQ ID NO: 14 - DNA, 163 bp, Homo sapiens
gatccttatattatcctacttggcttgcacgtcttcgggtgcatgtatataccgctactgtgtcctcgccatcacctaaatgtgactcagtctgttccactgtaatatgttgtgaatttccttgtactgtacttttattgttggtcttcttgcatcgatgatc

SEQ ID NO: 15 - DNA, 287 bp, Homo sapiens
  misc_feature 250: n = a, t, c, or g
gatctggggagctcagtgaacctcctcaccctcctgccagtatgaagttgggaagcgccttctctgtcccccagaacagaacaaactcttgttccctgtggttggggaaaaggtgtggggggcttggacctaggaagaagctgagctgaattcctccagggcccaggtgaaacccccaggggagtttctgagactctagacttgccatttctccacttttccttcccaatgactccggtgagcagctcanagtctgggctagggcaactggtaggacagtggggatc

SEQ ID NO: 16 - DNA, 210 bp, Homo sapiens
  misc_feature 171: n = a, t, c, or g
  misc_feature 188: n = a, t, c, or g
gatctccggtcccttcccccatcatccttccttagactgatgctttgactgaatcatcactagctatggcattaaaaggcctctcttctcatctggtgccaaaggttccgttgcagctttttacaaccatccggtgtggtttggaggatttgtttttttttttcccaacanaaaggaacagccattanaagaaggctcccattttctgat

SEQ ID NO: 17 - DNA, 227 bp, Homo sapiens
gatctcgttcatactgtggtggtgtttcgtttttgtttttgtttttaaagaagggtgaagatgcctgacgcacgaaaactgcactcgtgaggtttttccaccctgagatgacctacacggcagcggtggacagcacctgcctcgtcttctcctctttgaaaaaaagagagagagagagtcccctttcctttcactttctccctccaaaacagctgcctaaagagatc

SEQ ID NO: 18 - DNA, 381 bp, Homo sapiens
gatctttctaccattcgggcgtggctcgctcctgattccccttggaaatgaacttttatttggtttactgacatttatgtagatttccagtgaaaagctctataaaatacaataaataatacggggttgaaaaggcagacattctagttgcatatattacaggctttatccttacggtccaggccattggaactgcaatgtggagactgtttgtaatcagacatggaaaggctgcacgttctaaaggcgagacagctgctttcggttgggaatcatcacactccctccgctcacgccgctcttcccttcccccgctgtttcacacgctgcttccagagtttgtccagcaaggaataaatgaatgcatacaggacttttggc

SEQ ID NO: 19 - DNA, 1905 bp, Homo sapiens
  CDS (289)...(831)
ctccacgttgcgatggatccttggacccacttttgttaactcttaaactttgtgtctttgtctttatttcttttctcattccctcgtctccaccgggaaggggagagcctgcgggtggtgtatcaggcaggttcccctacatctttggcacccaacacggtctcctcgaacccaggtgaagttacacctgagcgtggtcgttgtgaagaacggtctgtccaggaactcccgagaacgtgtggtcggccttgcggtaagcttgtgcactcggagcattccagggacaccatgggacaatccaaaagtaaacattctgcatatttacattttattaagctcctcttaaagagggcaggaattaaggctagcacagaaaatttgattactctgtttccaacagtagagcaatattgtccttggtttcctgaacatggtaccatggacttcaaagattgggaacaggtgggaattgccttaaaacaagtttgtaaggaaggaaaatttatccccctaacagcctggtcaaactgggctatagttaaagcagcctcggaaccgtttcaatcggaaaatgaggcttatcctccagcagaaagaatttctgcagaggaaggtggtgatgctgctgaaggaggagaggatagtgaagaagattttgaggaaaatacagacaaacctggagatgagttaatttcttttgaggagcacgtgggaccttcagctgctcctaaaatagagaagccatatatgccaagatgtttaaaacaaagaagggccttgaggagcagtcggctcctcattgggatcatccggagtggccgcctccaataaagcaatgtagcttggagccttggaggtctgaatctcaaatttgccctgtttcacgaatgaatgaattgtggcctcaggaaccacaagcgcatggtgtagcaccagtacaacataaggctgcactgccatctaatgttaatgaatcgccattacagtttattattcggcaggctagattagccggagatcttgatgcctggcagtttgcagtagttttgcaacccccacgacagcaaggtggagcccatcaagcggtatgggaaccattttcttttaagctgctcaaagatcttaaagcagctgttggtcagtatggtcccaattcgcctttcatccgatcgctattgcaatctgtggctcagaataagctattgactccgtgtgattgggagattttaacgaaagttacactttcgccctcccaatttcttcagtttaagacttggtggaccgacgaggctcaaaatcaagatcgaaaaaaccgtgctgctaatcctgctattgccattacatttgaacaacttctaggaatagggggtcaatggggaactgtaaacaaccatcaggacttcgagatgatgccattgaacaaattcgcaattgctgtttgagggcatgggagaaaattcaggatctgggaactacttatcagtcttttaattctattagacaaggctcaaaggaaccatatcctgatttcattgctcgccttcaagacgcagcacagaaggctctcactgatgaaagtgccaggaaggccgggtgcggtggctcatgcctgtaatcccagcactttgggaggccgaggtgggcggatcacctgaggtcgggagttggagaccagcctgaccaacatggagaaaccccgtctctactaaaaatataaaaattagccgggcgtgatggcacatgtctgtaatcccagctactcaggaggctgaggcaggagaattgcttgaacccaggaggcggaggttgcggtgagccgagatcacgccactgcactccagcctgggtaacaagagcgaaactccgcctcaaaaaaaaaaaaaaaaaaaaaaaaaaaaaaaaaaa

SEQ ID NO: 20 - protein, 180 aa, Homo sapiens [sequence omitted]

SEQ ID NO: 21 - DNA, 1901 bp, Homo sapiens
  CDS (756)...(1442)
ctccacgttgcgatggatccttggacccacttttgttaactcttaaactttgtgtctttgtctttatttcttttctcattccctcgtctccaccgggaaggggagagcctgcgggtggtgtatcaggcaggttcccctacatctttggcacccaacacggtctcctcgaacccaggtgaagttacacctgagcgtggtcgttgtgaagaacggtctgtccaggaactcccgagaacgtgtggtcggccttgcggtaagcttgtgcactcggagcattccagggacaccatgggacaatccaaaagtaaacattctgcatatttacattttattaagctcctcttaaagagggcaggaattaaggctagcacagaaaatttgattactctgtttccaacagtagagcaatattgtccttggtttcctgaacatggtaccatggacttcaaagattgggaacaggtgggaattgccttaaaacaagtttgtaaggaaggaaaatttatccccctaacagcctggtcaaactgggctatagttaaagcagcctcggaaccgtttcaatcggaaaatgaggcttatcctccagcagaaagaatttctgcagaggaaggtggtgatgctgctgaaggaggagaggatagtgaagaagattttgaggaaaatacagacaaacctggagatgagttaatttcttttgaggagcacgtgggaccttcagctgctcctaaaatagagaagccatatatgccaagatgtttaaaacaaagaagggccttgaggagcagtcggctcctcattgggatcatccggagtggccgcctccaataaagcaatgtagcttggagccttggaggtctgaatctcaaatttgccctgtttcacgaatgaatgaattgtggcctcaggaaccacaagcgcatggtgtagcaccagtacaacataaggctgcactgccatctaatgttaatgaatcgccattacagtttattattcggcaggctagattagccggagatcttgatgcctggcagtttgcagtagttttgcaacccccacgacagcaaggtggagcccatcaagcggtatgggaaccattttcttttaagctgctcaaagatcttaaagcagctgttggtcagtatggtcccaattcgcctttcatccgatcgctattgcaatctgtggctcagaataagctattgactccgtgtgattgggagattttaacgaaagttacactttcgccctcccaatttcttcagtttaagacttggtggaccgacgaggctcaaaatcaagatcgaaaaaaccgtgctgctaatcctgctattgccattacatttgaacaacttctaggaatagggggtcaatggggaactgtaaacaaccatcaggacttcgagatgatgccattgaacaaattcgcaattgctgtttgagggcatgggagaaaattcaggatctgggaactacttatcagtcttttaattctattagacaaggctcaaaggaaccatatcctgatttcattgctcgccttcaagacgcagcacagaaggctctcactgatgaaagtgccaggaaggccgggtgcggtggctcatgcctgtaatcccagcactttgggaggccgaggtgggcggatcacctgaggtcgggagttggagaccagcctgaccaacatggagaaaccccgtctctactaaaaatataaaaattagccgggcgtgatggcacatgtctgtaatcccagctactcaggaggctgaggcaggagaattgcttgaacccaggaggcggaggttgcggtgagccgagatcacgccactgcactccagcctgggtaacaagagcgaaactccgcctcaaaaaaaaaaaaaaaaaaaaaaaaaaaaaaa

SEQ ID NO: 22 - protein, 228 aa, Homo sapiens [sequence omitted]

SEQ ID NO: 23 - DNA, 4033 bp, Homo sapiens
  CDS (25)...(4011)
cggagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagtgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaacacacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagatgcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctctgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagggatagtatccaaagccaccaagaaagcctttctgttctcaggtccagcaatgagtttatgcgctatgcagtgaatgtagctctgcagaaagtacagcagctaaaggaaacagggcatgtgagtggccctgatggccaaaacccagaaaagatctttcagaacctctgtgacataactcgagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaatcccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggcgaagatgaaaatgaagagggcactgcatcagagcatgggggacagaacaaagaaccagccaagaagaaaaggaaaaaataaatgaaatgcctgagttaatgtg

SEQ ID NO: 24 - protein, 1328 aa, Homo sapiens
MDQKILSLAAEKTADKLQEFLQTLREGDLTNLLQNQAVKGKVAGALLRAIFKGSPCSEEAGTLRRRKIYTCCIQLVESGDLQKEIVSEIIGLLMLEAHHFPGPLLVELANEFISAVREGSLVNGKSLELLPIILTALATKKENLAYGKGVLSGEECKKQLINTLCSGRWDQQYVIQHTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLDACILTQGDKISLQEPLDYLLCCIQHCLAWYKNTVIPLQQGEEEEEEEEAFYEDLDDILESITNRMIKSELEDFELDKSADFSQSTSIGIKNNISAFLVMGVCEVLIEYNFSISSFSKNRFEDILSLFMCYKKLSDILNEKAGKAKTKMANKTSDSLLSMKFVSSLLTALFRDSIQSHQESLSVLRSSNEFMRYAVNVALQKVQQLKETGHVSGPDGQNPEKIFQNLCDITRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPAKKKRKK

SEQ ID NO: 25 - DNA, 4603 bp, Homo sapiens
  CDS (846)...(3911)
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggtttgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccggtaggtatccaagtttctaacacaactttctaactatttttttattattattttcagttgatgtagaactttacaaaatctattgacttcaaagagggatcaaaacaatcatattctacagatgtacccaatagatatatggattcaattaagtttggtagaagatgagaacaaaataactactgatttaggaaaattggatgcagaataataattatagtaggggcaattttgtctgtagatggcagtatgacaattcttgctagagaatatattgaaaaaaacttcaacacaaagggttgtagcactgtcctcagtaccattgtgtgcatgaggatcagaatagtctgggctagatacatcacattaaagcttttcagaatctgataaatagctctaaatactaatgatattgagaagcctagcttcacttgggaaaatctgtggctgttcacagaaattcagcaccaagttattccccccatactctaccaggccttcaggtcctcataaagaaaagtgtcgttttcagattaggaactcaaaattattttggtgcatcaaatctacagtcacacaatataacaagaatgggattagaaaaatgaaagcctactcattctcatctttaagccagagaatgaaatatatatgaggtctctggatagctatttaaatatttgcatatttatgcaaggtattttgagcccttcagaagacattct

SEQ ID NO: 26 - protein, 1021 aa, Homo sapiens
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVCYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPVGIQVSNTTF

SEQ ID NO: 27 - DNA, 1520 bp, Homo sapiens
  CDS (103)...(903)
ccacgcgtccgcggacgcgtgggcggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcaggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcatgaaatgttataagtagacataaaaaaaaaaaaaaaaaaaaaa

SEQ ID NO: 28 - protein, 266 aa, Homo sapiens
MMALGAAGATRVFVAMVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 29 - DNA, 562 bp, Homo sapiens
  CDS (3)...(374)
agatggcccgaggcagcgccctcctgctcgcctccctcctcctcgccgcggccctttctgcctctgcggggctctggtcgccggccaaggaaaaacgaggctggaccctgaacagcgcgggctacctgctgggcccacatgccgttggcaaccacaggtcattcagcgacaagaatggcctcaccagcaagcgggagctgcggcccgaagatgacatgaaaccaggaagctttgacaggtccatacctgaaaacaatatcatgcgcacaatcattgagtttctgtctttcttgcatctcaaagaggccggtgccctcgaccgcctcctggatctccccgccgcagcctcctcagaagacatcgagcggtcctgagagcctcctgggcacgtttgtctgtgtgctgtaacctgaagtcaaaccttaagataatggataatcttcggccaatttatgcggagtcagccattcctgttctctttgccttgatgttgtgttgttatcatttaagattttttttttttggtaattattttgagtggcaaaataaagaatagcaatta

SEQ ID NO: 30 - protein, 123 aa, Homo sapiens
MARGSALLLASLLLAAALSASAGLWSPAKEKRGWTLNSAGYLLGPHAVGNHRSFSDKNGLTSKRELRPEDDMKPGSFDRSIPENNIMRTIIEFLSFLHLKEAGALDRLLDLPAAASSEDIERS

SEQ ID NO: 31 - DNA, 1402 bp, Homo sapiens
  CDS (250)...(1326)
ggcacgagggtttcgttttcatgctttaccagaaaatccacttccctgccgaccttagtttcaaagcttattcttaattagagacaagaaacctgtttcaacttgaagacaccgtatgaggtgaatggacagccagccaccacaatgaaagaaatcaaaccaggaataacctatgctgaacccacgcctcaatcgtccccaagtgtttcctgacacgcatctttgcttacagtgcatcacaactgaagaatggggttcaacttgacgcttgcaaaattaccaaataacgagctgcacggccaagagagtcacaattcaggcaacaggagcgacgggccaggaaagaacaccacccttcacaatgaatttgacacaattgtcttgccggtgctttatctcattatatttgtggcaagcatcttgctgaatggtttagcagtgtggatcttcttccacattaggaataaaaccagcttcatattctatctcaaaaacatagtggttgcagacctcataatgacgctgacatttccatttcgaatagtccatgatgcaggatttggaccttggtacttcaagtttattctctgcagatacacttcagttttgttttatgcaaacatgtatacttccatcgtgttccttgggctgataagcattgatcgctatctgaaggtggtcaagccatttggggactctcggatgtacagcataaccttcacgaaggttttatctgtttgtgtttgggtgatcatggctgttttgtctttgccaaacatcatcctgacaaatggtcagccaacagaggacaatatccatgactgctcaaaacttaaaagtcctttgggggtcaaatggcatacggcagtcacctatgtgaacagctgcttgtttgtggccgtgctggtgattctgatcggatgttacatagccatatccaggtacatccacaaatccagcaggcaattcataagtcagtcaagccgaaagcgaaaacataaccagagcatcagggttgttgtggctgtgttttttacctgctttctaccatatcacttgtgcagaattccttttacttttagtcacttagacaggcttttagatgaatctgcacaaaaaatcctatattactgcaaagaaattacacttttcttgtctgcgtgtaatgtttgcctggatccaataatttactttttcatgtgtaggtcattttcaagaaggctgttcaaaaaatcaaatatcagaaccaggagtgaaagcatcagatcactgcaaagtgtgagaagatcggaagttcgcatatattatgattacactgatgtgtaggccttttattgtttgttggaatcgatatgtacaaagtgtaaataaatgtttcttttcattatccttaaaaaaaaaa

SEQ ID NO: 32 - protein, 358 aa, Homo sapiens
MGFNLTLAKLPNNELHGQESHNSGNRSDGPGKNTTLHNEFDTIVLPVLYLIIFVASILLNGLAVWIFFHIRNKTSFIFYLKNIVVADLIMTLTFPFRIVHDAGFGPWYFKFILCRYTSVLFYANMYTSIVFLGLISIDRYLKVVKPFGDSRMYSITFTKVLSVCVWVIMAVLSLPNIILTNGQPTEDNIHDCSKLKSPLGVKWHTAVTYVNSCLFVAVLVILIGCYIAISRYIHKSSRQFISQSSRKRKHNQSIRVVVAVFFTCFLPYHLCRIPFTFSHLDRLLDESAQKILYYCKEITLFLSACNVCLDPIIYFFMCRSFSRRLFKKSNIRTRSESIRSLQSVRRSEVRIYYDYTDV

SEQ ID NO: 33 - DNA, 1345 bp, Homo sapiens
  CDS (24)...(692)
cttgtgttttccaccctgaaagaatgttgtggctgctcttttttctggtgactgccattcatgctgaactctgtcaaccaggtgcagaaaatgcttttaaagtgagacttagtatcagaacagctctgggagataaagcatatgcctgggataccaatgaagaatacctcttcaaagcgatggtagctttctccatgagaaaagttcccaacagagaagcaacagaaatttcccatgtcctactttgcaatgtaacccagagggtatcattctggtttgtggttacagacccttcaaaaaatcacacccttcctgctgttgaagtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtagaagaaagaacaaagaaccatctgaagtggatgacgctgaagataagtgtgaaaacatgatcacaattgaaaatggcatcccctctgatcccctggacatgaagggagggcatattaatgatgccttcatgacagaggatgagaggctcacccctctctgaagggctgttgttctgcttcctcaagaaattaaacatttgtttctgtgtgactgctgagcatcctgaaataccaagagcagatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatcaggcatatgtatatattttcacacttcaaagacctaaggaaaaataaattttccagtggagaatacatataatatggtgtagaaatcattgaaaatggatcctttttgacgatcacttatatcactctgtatatgactaagtaaacaaaagtgagaagtaattattgtaaatggatggataaaaatggaattactcatatacagggtggaattttatcctgttatcacaccaacagttgattatatattttctgaatatcagcccctaataggacaattctatttgttgaccatttctacaatttgtaaaagtccaatctgtgctaacttaataaagtaataatcatctctttttgattgtg

SEQ ID NO: 34 - protein, 222 aa, Homo sapiens
MLWLLFFLVTAIHAELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPIWIIIFGVIFCIIIVAIALLILSGIWQRRRKNKEPSEVDDAEDKCENMITIENGIPSDPLDMKGGHINDAFMTEDERLTPL

SEQ ID NO: 35 - DNA, 992 bp, Homo sapiens
  CDS (178)...(861)
ttcggcacgagcggcacgagaagccccagacggtatctccgagatgccagtgagcggctgagagctgaagccccctggacactcaaggctcttgtggtgacagtctgacgtaaaggcgtgcagggaggcctagctctgtctcctggacttagagatttcagacacagaagtctgtccatggctccttgtcacatccgcaaataccaggagagcgaccgccagtgggttgtgggcttgctctcccgggggatggccgagcatgccccagccaccttccggcaattgctgaagctgcctcgaaccctcatactcttacttggggggcccctcgccctactcctggtctctggatcctggcttctagccctcgtgttcagcatcagcctcttccctgccctgtggttccttgccaaaaaaccctggacggagtatgtggacatgacattgtgcacagacatgtctgacattaccaaatcctacctgagtgagcgtggctcctgcttctgggtggctgagtctgaagagaaggtggtgggcatggtaggagctctgcctgttgatgatcccaccttgagggagaagcggttgcagctgtttcatctctctgtggacagtgagcaccgtcgtcaggggatagcaaaagccctggtcaggactgtcctccagtttgcccgggaccagggctacagtgaagttatcctggacaccggcaccatccagctctctgctatggccctctaccagagcatgggcttcaagaagacgggccagtccttcttctgtgtgtgggccaggctagtggctcttcatacagttcatttcatctaccacctcccttcttctaaggtagggagtctgtgatctctttctgtgtgtattggtcagaatagaatccattcagctgtagcagcaagcaatccccaacctttcactgcaatgacctttcaatgcaataaaagcttattgtccattcaaaaaaaaaaaaaaaaaaa

SEQ ID NO: 36 - protein, 227 aa, Homo sapiens
MAPCHIRKYQESDRQWVVGLLSRGMAEHAPATFRQLLKLPRTLILLLGGPLALLLVSGSWLLALVFSISLFPALWFLAKKPWTEYVDMTLCTDMSDITKSYLSERGSCFWVAESEEKVVGMVGALPVDDPTLREKRLQLFHLSVDSEHRRQGIAKALVRTVLQFARDQGYSEVILDTGTIQLSAMALYQSMGFKKTGQSFFCVWARLVALHTVHFIYHLPSSKVGSL

SEQ ID NO: 37 - DNA, 2529 bp, Homo sapiens
  CDS (1517)...(2191)
atcagtgggccagagctcgccgggtggccgcaagtacgccggcccagcccgcagcgcgcccagccggaaggcggggaatccggctgacaccgcgccccgggttcccaggccacctcctctgttctgaggctgggctgggagaccgtggggctgtgaggagcgcatagaaccgtggtggagggcgaggctgggccaccggctcttcaagctcggaatggagggggaagagcgcagagggctggctgggaggaactcgggtgggcgtgaaggagacgagggcaagaaaagaaacttcccttcttccaggagggtcttcgaaaccctctccccacagcccctctcgtcattagcatggcaatgaggagtttctgtaattcgacttggaggggcggatgagccctggaaactcagagctcgccggaaaaggccgggggcggccgggctcttcttccccaccttccctctctcgtcgctctccgcccctttctctttcccactcagttttgcaccgggagccctccgggatgcggagctactcgaccgccggatttttaggggtaggaggcgggggagagagatgacgctggcggacgtggccagcgcgggggccgggcggtgcgctgcaggccatctgccggcgccctgagacccaggagcctccgcgctcccgcgtgggcctcacagggccggtccacagctccaacatagtagctgaactcccttcgttgcgttcctctttttctggaggggaatgttagaagagagagagagcttccttttataaccttcctcattctgctgcacgtctagagtgggtgtgggggctggcaggtgggaggggcggtggacaaatggctgatggtggacgggacactttaccccaacgacacctcctcccctttccaactggctgtgtagttgcttatgagaaccttcaagtccttccctagagagacacatgcaaatctgagcctcatcccaggccaggggtcctgttcctcatcaccctacttccctgaggctgctgaggtcgttaaattgttgtttactattaggtttcacgtcaaccctgggcttgtagagagaaaaagccaaacggagaccaagaattgatgcagtcttgggtaggagaaatcgagagcttgtccaggaagctttgctgtataaattataagcaatgctgtataaattttactccaaccatgtgtacaatgttggaatcagatgaaatttatagtgaatgaatgtatgtgggtttggggtttccactcctcttcagcctttcctcccgttagaacaaggaaggttttttttttttcaaggaaggtacatttcaaatatgttagtcaccctttcagtcttctgtattctgttctccacgtaccgaagttcccccaaacctgtcctctcaagagaaaaaacccatgctgactctggactccctcagtaacaatgaaacattctccccaaacatttcctttcagaatagtatttgtgactttgatccatcccaagcatggttaagagggagcacgggcaggaaaggcccactttctggggttgggcagccacccctgccccagtttcggctcctgggaatcctccgactggagaaggggaaaggcaaggcagtcctcctggaggcggcttccttgggagcaccagcttccagcggcggggagagaaggagctcctgtgggagagggggcaggatgtgagtaggtcggtgctggctatgcgagcaatcctccctccaagcctgagcaagtcggtacattttcccccgctgcctcattcctgtaccttggttgccctcctcagcctgggtttgcaggaccccctcggctgcagggcgcctgccacaaagccgaccccggcaggagccactctctctgctagttcgctgcctcggccctgctctccctcagcctctcttcttctctcctggcctcttttctggggcatcctgggtggagtgtttttcttgggatcacgagcttgcactcgcacacaggcccgcagacacacaggcccggcggccgcccttctccgcttactgttcccggctccccgcaggccgggtgctcgcagccgggctggctatgcctcgcctggcagcccagagcgccgctccccgggaacagcacacaaaggcagcctcccctggcctctagcccttaggcttctgtagctcagttctttccccacacccctcccccaagaaattctgggggccgttccaccgagtaggagatccttggccctctaggcaagtaggtcagcgccccaagactggagctggtctctttcaacgccttgggagactgggtgaaaggcgagcttggttacgcttaaaatgatcgcctacaagcggttctcttggctcaaaacgcctctttcagggctcttatgctagaaaggaaaggaataaggaggagataaaatgacgccgaggccctgaactgttcatggcatccgcggctcagccaagctgttgttttaaaagagcaataaaaatgaattatgact

SEQ ID NO: 38 - protein, 224 aa, Homo sapiens
MVKREHGQERPTFWGWAATPAPVSAPGNPPTGEGERQGSPPGGGFLGSTSFQRRGEKELLWERGQDVSRSVLAMRAILPPSLSKSVHFPPLPHSCTLVALLSLGLQDPLGCRAPATKPTPAGATLSASSLPRPCSPSASLLLSWPLFWGILGGVFFLGSRACTRTQARRHTGPAAALLRLLFPAPRRPGARSRAGYASPGSPERRSPGTAHKGSLPWPLALRLL

SEQ ID NO: 39 - DNA, 2749 bp, Homo sapiens
  CDS (198)...(770)
gccgcccaggattccacgagggggaaggattctctattcttttttgcgacaaatctggtaacaggatttgctgtgctgttttcgtccgtgtgtgtgtgcgtgtgtgtgtgtgttcgtgtggatgcacgtgtggccccgctggggtgccccctccagtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacaggggagtgctggaaccgcggagtttggctcaccgcaaagctacaacgatggactcttgcatagaaaaaaaaatcttgttaacaatgaaaaaatgagcaaacaaaaaaatcgaaagacaaacgggagagaaaaagaggaaggaaacttatttcttaactgctatttggcagaagctgaaattggagaaccaaggagcaaaaacaaattttaaaattaaagtattttatacatttaaaaatatggaaaaacaacccagacgattctcgagagactggggggagttaccaacttaaatgtgtgtttttaaaaatgcgctaagaaggcaaagcagaaagaagaggtatacttatttaaaaaactaagatgaaaaaagtgcgcagctgggaagttcacaggttttgaaactgacctttttctgcgaagttcacgttaatacgagaaatttgatgagagaggcggctcttttacgttgaatcagatgctttgagtttaaaacccaccatgtatggaagagcaagaaaagagaaaatattaaaacgaggagagagaaaaataatattaacacaaaaaaatgccacagacaatgatttctctgagaaattattatggcaaaactgtctggactgctgacagtaaattccggtttgcatgttacttgtattccattgatggtgtgtcttcctcccacccccttatctcccatgcactcactccattttcatcttcactatgaaaaacaataccaaaagtatctggaaattgatatatatatatccacatatatatatcatatatttgccatatatatatatatatatatatatatatatatatatatatatatatatatttgccctgtctttgatcctggggaacaaaagaaaaaagtcagaaagggaaaaaattacactcattgccctaagaagacagaggtgggcagaatatgtggggaaaggaaaaagaaaacaagaccaccaaatgaaataatgaaggtacagcgcctcgctgtgccagacacagtaggcgctcaatcagtattagttcccaccattccccttttcttgtgttccttcttgttggtttcctgaagtcctatttgaagacagtggtttatttccccctctctatcccgtcaaattcaccttaaataacacccagctagatacaggcactaggtttgtgtaagatatgttgatacacacgaacaaagtttattttgactataatgtgtggactgactttcaacatttgcattttatctcacaaaggtgtatctattcaagtaacctttttttttttgtttgtttgtttcttttttgtttttttttttcttttggttgtttgtttcaattcatgtagctatttaaactgggataccttggactaagccagtctgtatcccaattcgctagcaagcctaagtttgtggggttttgtttttgtttttgttttaccttctaatttacaagaaagaggaaaagctcttctaactgaactttggtatgcggttgagctttgtaactatttgttctccatgaaaacaaaattatttatatttgacatatttttttctagtgtattaagttattttaaacaaaagatgttatctcatgacgtgttgtcagtacaaaatgtgtcgcctccaattctgttaaaccttttaaataagtgccaagttattaatt

SEQ ID NO: 40 - protein, 190 aa, Homo sapiens
MEDEGQTKIKQRRSRTNFTLEQLNELERLFDETHYPDAFMREELSQRLGLSEARVQVWFQNRRAKCRKQENQLHKGVLIGAASQFEACRVAPYVNVGALRMPFQQVQAQLQLDSAVAHAHHHLHPHLAAHAPYMMFPAPPFGLPLATLAADSASAASVVAAAAAAKTTSKNSSIADLRLKAKKHAAALGL

SEQ ID NO: 41 - DNA, 1941 bp, Homo sapiens
  CDS (72)...(1100)
cggatggggaaaaaaaaagatgtcagctcctccgctgtagtattgctccttaaaaacccctctctctgaaaatgacatgccctcgcaatgtaactccgaactcgtacgcggagcccttggctgcgcccggcggaggagagcgctatagccggagcgcaggcatgtatatgcagtctgggagtgacttcaattgcggggtgatgaggggctgcgggctcgccccctcgctctccaagagggacgagggcagcagccccagcctcgccctcaacacctatccgtcctacctctcgcagctggactcctggggcgaccccaaagccgcctatcgcctggaacaacctgttggcaggccgctgtcctcctgctcctacccacctagtgtcaaggaggagaatgtctgctgcatgtacagcgcagagaaccgggcgaaaagtggccctgaggcagctctctactcccaccccttgccggagtcctgccttggggagcacgaggtacccgtccccagctactaccgcgccagcccgagctactccgcgctggacaagacgccccactgttctggggccaacgacttcgaagcccctttcgagcagcgggccagtctcaacccgcgcgccgaacatctggaatcgcctcagctggggggcaaagtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaagaggagataaaggcagaaaacaccacaggaaattggctgactgcaaagagcggaaggaagaagaggtgcccctatactaaacaccagacgctggaattggagaaagaatttctgttcaatatgtatttgacgcgagagcgccgcctggagattagcaagaccattaaccttacagacagacaagtcaaaatctggtttcaaaatcgcagaatgaaactcaagaaaatgaaccgagagaatcggatccgggaactgacctccaattttaatttcacctgagagcgcggcctctcctcctcccttcccgctccttgctctccccgcccctcctccctttgtgcctggtgatatatttttttttcctccctgagtataaatgcaatgcgactgcaaaaaaggcaaagacctcagactctccttccaagggacctgtggttcgtgctgcgaagatgcttccacttaaagcatgagaaatggggtgccgggatgtggggtgtggtgtgtgccctcatagatgggggtgggagtgtggctggtgtgtgtgtcaaaccctcactcacccacgcactcacacacagcattctgttctccatgcaaagttaagatcgaatccatccgcttgtaggggaaaaaaaggaaaaaaattaaccagagagggtctgtaatctcgcagagcacaggcagaatcgttccttccttgctgcatttcctccttagactaatagacgttttggaaagttcggctagtgttcgtgtgtttgtcgtagcacccagagcctccaccaaaccctctccatgtctttacctcccagtcgctctaagatctgcttgaagtctcgtatttgtactgctttctgcttttctcccacccctcctagcacccccacatcccccatctagtaacatctcagaaatttcatccagaggaacaaaaaaattaaaaatagaacatagcaaagcaaagacagaatgcccccccccaaatattgtcctgtccctgtctgggagttgtgttatttaaagatattctgtatgttgtatcttttgcatgtagcttccttaatggagaaaaaaaaatcctaataaatttccagaatcataaaaaaaaaaaaaaaaaaaa

SEQ ID NO: 42 - protein, 342 aa, Homo sapiens
MTCPRNVTPNSYAEPLAAPGGGERYSRSAGMYMQSGSDFNCGVMRGCGLAPSLSKRDEGSSPSLALNTYPSYLSQLDSWGDPKAAYRLEQPVGRPLSSCSYPPSVKEENVCCMYSAENRAKSGPEAALYSHPLPESCLGEHEVPVPSYYRASPSYSALDKTPHCSGANDFEAPFEQRASLNPRAEHLESPQLGGKVSFPETPKSDSQTPSPNEIKTEQSLAGPKGSPSESEKERAKAADSSPDTSDNEAKEEIKAENTTGNWLTAKSGRKKRCPYTKHQTLELEKEFLFNMYLTRERRLEISKTINLTDRQVKIWFQNRRMKLKKMNRENRIRELTSNFNFT

SEQ ID NO: 43 - DNA, 2186 bp, Homo sapiens
  CDS (118)...(1236)
actctttcttcggctcgcgagctgagaggagcaggtagaggggcagaggcgggactgtcgtctgggggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccggacttcgccacgcagccgcagcacgttcagaacttcctcctgtacagacactgccgccactttcccctgctgcaggacgtgcccccctctaagtgcgcgcagccggtcttcctgctgctggtgatcaagtcctcccctagcaactatgtgcgccgcgagctgctgcggcgcacgtggggccgcgagcgcaaggtacggggtttgcagctgcgcctcctcttcctggtgggcacagcctccaacccgcacgaggcccgcaaggtcaaccggctgctggagctggaggcacagactcacggagacatcctgcagtgggacttccacgactccttcttcaacctcacgctcaagcaggtcctgttcttacagtggcaggagacaaggtgcgccaacgccagcttcgtgctcaacggggatgatgacgtctttgcacacacagacaacatggtcttctacctgcaggaccatgaccctggccgccacctcttcgtggggcaactgatccaaaacgtgggccccatccgggctttttggagcaagtactatgtgccagaggtggtgactcagaatgagcggtacccaccctattgtgggggtggtggcttcttgctgtcccgcttcacggccgctgccctgcgccgtgctgcccatgtcttggacatcttccccattgatgatgtcttcctgggtatgtgtctggagcttgagggactgaagcctgcctcccacagcggcatccgcacgtctggcgtgcgggctccatcgcaacacctgtcctcctttgacccctgcttctaccgagacctgctgctggtgcaccgcttcctaccttatgagatgctgctcatgtgggatgcgctgaaccagcccaacctcacctgcggcaatcagacacagatctactgagtcagcatcagggtccccagcctctgggctcctgtttccataggaaggggcgacaccttcctcccaggaagctgagacctttgtggtctgagcataagggagtgccagggaaggtttgaggtttgatgagtgaatattctggctggcgaactcctacacatccttcaaaacccacctggtactgttccagcatcttccctggatggctggaggaactccagaaaatatccatcttctttttgtggctgctaatggcagaagtgcctgtgctagagttccaactgtggatgcatccgtcccgtttgagtcaaagtcttacttccctgctctcacctactcacagacgggatgctaagcagtgcacctgcagtggtttaatggcagataagctccgtctgcagttccaggccagccagaaactcctgtgtccacatagagctgacgtgagaaatatctttcagcccaggagagaggggtcctgatcttaaccctttcctgggtctcagacaactcagaaggttggggggataccagagaggtggtggaataggaccgccccctccttacttgtgggatcaaatgctgtaatggtggaggtgtgggcagaggagggaggcaagtgtcctttgaaagttgtgagagctcagagtttctggggtcctcattaggagcccccatccctgtgttccccaagaattcagagaacagcactggggctggaatgatctttaatgggcccaaggccaacaggcatatgcctcactactgcctggagaagggagagattcaggtcctccagcagcctccctcacccagtatgttttacagattacggggggaccgggtgagccagtgaccccctgcagcccccagcttcaggcctcagtgtctgccagtcaagcttcacaggcattgtgatggggcagccttggggaatataaaattttgtg

SEQ ID NO: 44 - protein, 372 aa, Homo sapiens
MKYLRHRRPNATLILAIGAFTLLLFSLLVSPPTCKVQEQPPAIPEALAWPTPPTRPAPAPCHANTSMVTHPDFATQPQHVQNFLLYRHCRHFPLLQDVPPSKCAQPVFLLLVIKSSPSNYVRRELLRRTWGRERKVRGLQLRLLFLVGTASNPHEARKVNRLLELEAQTHGDILQWDFHDSFFNLTLKQVLFLQWQETRCANASFVLNGDDDVFAHTDNMVFYLQDHDPGRHLFVGQLIQNVGPIRAFWSKYYVPEVVTQNERYPPYCGGGGFLLSRFTAAALRRAAHVLDIFPIDDVFLGMCLELEGLKPASHSGIRTSGVRAPSQHLSSFDPCFYRDLLLVHRFLPYEMLLMWDALNQPNLTCGNQTQIY

SEQ ID NO: 45 - DNA, 2575 bp, Homo sapiens
  CDS (14)...(2260)
ctgatggcgatgaatgaacactgcgtttgctgggaagatggtgtcggtcaccaaatatgaccttactggctgctctgccttctgcaggtcctgccagagagccaccatgacctctcagcctctcaggctagcagaagagtatggcccaagtcctggggagtctgaactggctgtgaacccctttgatgggcttcccttctcttcccgctactatgagctgctgaagcagcgccaagccttgcccatctgggctgctcgctttaccttcttggagcagttggagagtaaccccactggagtggtgctggtgtctggggagcctggttctggcaagagcacccagatccctcagtggtgtgcagagtttgcgctggccagagggttccagaaaggacaggttactgttactcagccctaccctcttgcagcccggagcctggctctgcgggttgctgatgagatggacctgaccctgggtcatgaggttggatacagcatcccccaggaggactgcacggggcccaacaccctgctcaggttctgctgggacaggctgcttctgcaggaggtggcctcgacccgaggcactggagcctggggcgtgctggtactagatgaggctcaggagcggtcggtggcatcagattcactccaggggctactgcaagatgccaggctggaaaaacttccgggggacctcagagtggttgtggttactgacccagcccttgaacctaagctccgagctttctggggcaatcctcctattgtgcatatacccagagagcctggtgagagaccttcccccatctactgggacaccatcccacctgatcgggtggaagctgcctgccaagcagtgcttgaattgtgtcggaaggagcttccaggagatgtgctagtgttcctgcccagtgaggaggaaatttccctgtgctgtgaatccttgtccagggaggtagagtccttgcttctccaagggcttccaccacgagtactgccccttcacccagactgtggacgagccgttcaggctgtgtatgaggacatggatgcccgaaaggttgtggtcactcactggctggctgacttctccttctccctcccttccatccaacatgtcatcgactcaggactggagctccgaagtgtttacaatcctaggatccgagcagaattccaagtgttgaggccaatcagcaagtgtcaggcagaggcaagacgattgcgagcaagagggttcccaccaggatcctgcctctgcctgtatcctaagtccttcttagaactagaagctccaccattgccacaacccagggtgtgtgaggagaatctgagctccctggtgttactactaaaaaggagacagattgcagagccaggggagtgtcacttcctggaccagcctgctccagaagcactgatgcaagccctggaagatttagactatctggcagccctggatgatgatggggacctgtcagatctgggtgtcatactatcagaattccctctggcccctgagctggccaaagccctgctggcctcatgcgagtttgactgtgtggacgagatgctcaccctggctgccatgctcacagctgcccctgggtttacccgtcctccactcagtgcagaagaagctgccctgcgtcgggccctggaacacacggatggtgaccacagttctctgatccaggtgtatgaagcctttatacaaagtggagcagatgaggcttggtgccaggctcgaggtctgaattgggcagcattgtgccaagcccataaacttcggggagaactcctagaactcatgcaacgaattgaacttcccttgtccctaccagcctttggctctgagcagaatcgcagagaccttcagaaagcactggtgtcaggatactttctcaaggtggccagagacacagacgggactggaaattaccttctcctaacccataagcatgtggcccagctctcctcatactgctgctaccgaagccgcagagctcctgccagacccccaccatgggtgctctaccacaatttcaccatatccaaagacaactgcctttccattgtttctgagattcaaccacagatgctggtggaattggcccctccatacttcctgagtaacttgcctcccagtgagagcagagaccttctgaaccagctaagggaaggaatggcagattctacagcagggagcaaatcatcctcagcccaggagttcagagatccctgtgtcctgcagtgacctgcctgcctatggaatggagctgggttcatctcatcacattagattatccctcagggtgacaccaaagcacccagacagatttagaagcccaaagtttagggtcaaatgtaaaccctggaacctgagtcccaagaaatggtagactgggaatggaaagaatggggtaaaccacagtctacatagggaaggactctttccttagccttctcttattgattggagagggactgacatgctcctcattctcttaactttgccaaacccattcttgtactcccttgtgatctataaaagatttttctatgatgccaa

SEQ ID NO: 46 - protein, 748 aa, Homo sapiens
MNTAFAGKMVSVTKYDLTGCSAFCRSCQRATMTSQPLRLAEEYGPSPGESELAVNPFDGLPFSSRYYELLKQRQALPIWAARFTFLEQLESNPTGVVLVSGEPGSGKSTQIPQWCAEFALARGFQKGQVTVTQPYPLAARSLALRVADEMDLTLGHEVGYSIPQEDCTGPNTLLRFCWDRLLLQEVASTRGTGAWGVLVLDEAQERSVASDSLQGLLQDARLEKLPGDLRVVVVTDPALEPKLRAFWGNPPIVHIPREPGERPSPIYWDTIPPDRVEAACQAVLELCRKELPGDVLVFLPSEEEISLCCESLSREVESLLLQGLPPRVLPLHPDCGRAVQAVYEDMDARKVVVTHWLADFSFSLPSIQHVIDSGLELRSVYNPRIRAEFQVLRPISKCQAEARRLRARGFPPGSCLCLYPKSFLELEAPPLPQPRVCEENLSSLVLLLKRRQIAEPGECHFLDQPAPEALMQALEDLDYLAALDDDGDLSDLGVILSEFPLAPELAKALLASCEFDCVDEMLTLAAMLTAAPGFTRPPLSAEEAALRRALEHTDGDHSSLIQVYEAFIQSGADEAWCQARGLNWAALCQAHKLRGELLELMQRIELPLSLPAFGSEQNRRDLQKALVSGYFLKVARDTDGTGNYLLLTHKHVAQLSSYCCYRSRRAPARPPPWVLYHNFTISKDNCLSIVSEIQPQMLVELAPPYFLSNLPPSESRDLLNQLREGMADSTAGSKSSSAQEFRDPCVLQ

SEQ ID NO: 47 - DNA, 5252 bp, Homo sapiens
  CDS (140)...(4063)
cacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacatgcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagcgggaagggcctgttggcggggagagtgactcggaggaaatgtttgagaagacgtcgggcttcgggagcgggaagccatcggaggccagcgagccatgccccacggagctcctgaaggcccgggaggactctgagtacctagtgaccctaaaacacgaggcccagcggctagagcggacggtggagcgcctcatcacggacaccgacagcttcctccatgatgcggggctgcggggtggtgcgcccttaccggggcctggcctccagggcgaagaggagcagggtgagggggaccagcaggagccccagctgctggggaccatcaacgccaagatgaaggctttcaagaaagagctgcaggccttcctggagcaggtgaaccgcattggggatggcctatcccccttgccccacctcacagagtcctctagcttcctctccactgtgacttccgtgtcccgggactcccccatcgggaacctggggaaggagctgggcccagacttgcagtccagactgaaagagcagctggagtggcagctcgggccggcccgaggggacgagcgggagagcctgcgcctccgagccgcgcgggagctgcaccgccgcgcagacggggacaccgggagccacgggctgggaggccagacctgcttcagcctggagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcagttgcagaaagagaacagtccccggagaggtggcagtttcctctgtgatcaaaaagacggcaacgttcgcccctttccccaccagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggaagaagaaaatcacaaaggaaatcttcaaagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaaggggggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttcccggagccttaggagcagacaggtggcccctgccatcgagaaggtgcaggccaagtttgaacgcacatgctgctcccccaagtatggttctcccaagctgcagaggaagcccctccccaaagccgaccagccaaataacaggacgtcaccagggatggcccagaaagggtacagtgagtcagcctgggcccgctccaccaccacaagggagagccccgtgcacaccaccattaatgatggcctctccagcctcttcaacatcattgaccacagccccgtggtgcaggaccccttccagaaggggctgcgggccggcagtcggtctcgctcagcagagccccgaccagagctgggcccaggccaggaaacaggcaccaattcccgaggaaggtcgcctagccccattggggtggggtcagagatgtgcagggaggaagggggagagggcacgccagtgaagcaggacttatctgctccccctggctacaccctcactgagaacgtggcccggatcctcaacaagaagctgctggaacatgccttaaaggaggagaggaggcaggctgcccacgggcccccgggtctccacagtgacagccactcgctgggggacacagccgagccagggcccatggagaaccaaactgtcttgctaactgccccctggggactctagccctgcccgcctcacgctgaactaccttgttctgcactagctccatccctagagccctgcttctccaggcccgagagaccagcaaaccgtcgccctccgtcccgttgggccccacattcccccactgcctcacagcctcagtcacccggagacccgacgtccttggaggagcatggtggcgaggagccgcccgaggagcagccacaccgagatgcaagcttgcatggattatcacagtataattcactgtaatttgcataaccacaccatcaccatgaacaaaactctgcccaacaggagagatctagttttctcaaggtcaaagaatgttttttaaaaacacaaagctgctgaatgttcaacctgtgaaactgagatgtttctagaatgaaacagtaaatgtgcctgtaataacttaatttttttcatagctcagaaaactatttttgtctccatcttttttacacacagtatattaaacgaaaaggtaaataaggtataaatagatttaaaaaataaaagttttaaaaaatgtacattttaagagattctgaacaccctcgctgtcaatacctgactgcctctgttaaatttgcactgttacattttggttcagtttatttccatgttgaattagagtggattaagttaattttattttgtcagtgttactgttttttacgaattttttaatgcttcagactgtctgattcagtgaactttttgtagtgaaaaagccatgaagccagtagacaagacagatattctgtatgctggaggggatacaggatgattttgaaaaggtacaaagtcctcagtgggcttagaaaattcactgtatgatccttatattatcctacttggcttgcacgtcttcgggtgcatgtatataccgctactgtgtcctcgccatcacctaaatgtgactcagtctgttccactgtaatatgttgtgaatttccttgtactgtacttttattgttggtcttcttgcatcgatgatccaacagcaacaccatttttaaattattgtgaaaagattaactggcaatgtacagagtttactcaaagttttcttaagggaaaacactacaaaaagtcacaaggataccaaatggaaacacatgatgatgcctctgggtctgtatgagaccgtgatgaagtagaaataaagcccttctgagatggc

SEQ ID NO: 48 - protein, 1307 aa, Homo sapiens
MEDMRGQQEREGPGRDHAPSIPTSPFGDSLESSTELRRHLQFVEEEAELLRRSISEIEDHNRQLTHELSKFKFEPPREPGWLGEGASPGAGGGAPLQEELKSARLQISELSGKVLKLQHENHALLSNIQRCDLAAHLGLRAPSPRDSDAESDAGKKESDGEESRLPQPKREGPVGGESDSEEMFEKTSGFGSGKPSEASEPCPTELLKAREDSEYLVTLKHEAQRLERTVERLITDTDSFLHDAGLRGGAPLPGPGLQGEEEQGEGDQQEPQLLGTINAKMKAFKKELQAFLEQVNRIGDGLSPLPHLTESSSFLSTVTSVSRDSPIGNLGKELGPDLQSRLKEQLEWQLGPARGDERESLRLRAARELHRRADGDTGSHGLGGQTCFSLEMEEEHLYALRWKELEMHSLALQNTLHERTWSDEKNLMQQELRSLKQNIFLFYVKLRWLLKHWRQGKQMEEEGEEFTEGEHPETLSRLGELGVQGGHQADGPDHDSDRGCGFPVGEHSPHSRVQIGDHSLRLQTADRGQPHKQVVENQQLFSAFKALLEDFRAELREDERARLRLQQQYASDKAAWDVEWAVLKCRLEQLEEKTENKLGELGSSAESKGALKKEREVHQKLLADSHSLVMDLRWQIHHSEKNWNREKVELLDRLDRDRQEWERQKKEFLWRIEQLQKENSPRRGGSFLCDQKDGNVRPFPHQGSLRMPRPVAMWPCADADSIPFEDRPLSKLKESDRCSASENLYLDALSLDDEPEEPPAHRPEREFRNRLPEEEENHKGNLQRAVSVSSMSEFQRLMDISPFLPEKGLPSTSSKEDVTPPLSPDDLKYIEEFNKSWDYTPNRGHNGGGPDLWADRTEVGRAGHEDSTEPFPDSSWYLTTSVTMTTDTMTSPEHCQKQPLRSHVLTEQSGLRVLHSPPAVRRVDSITAAGGEGPFPTSRARGSPGDTKGGPPEPMLSRWPCTSPRHSRDYVEGARRPLDSPLCTSLGFASPLHSLEMSKNLSDDMKEVAFSVRNAICSGPGELQVKDMACQTNGSRTMGTQTVQTISVGLQTEALRGSGVTSSPHKCLTPKAGGGATPVSSPSRSLRSRQVAPAIEKVQAKFERTCCSPKYGSPKLQRKPLPKADQPNNRTSPGMAQKGYSESAWARSTTTRESPVHTTINDGLSSLFNIIDHSPVVQDPFQKGLRAGSRSRSAEPRPELGPGQETGTNSRGRSPSPIGVGSEMCREEGGEGTPVKQDLSAPPGYTLTENVARILNKKLLEHALKEERRQAAHGPPGLHSDSHSLGDTAEPGPMENQTVLLTAPWGL

SEQ ID NO: 49 - DNA, 3832 bp, Homo sapiens
  CDS (140)...(3568)
cacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacacgcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagcgggaagggcctgttggcggggagagtgactcggaggagatgtttgagaagacgtcgggcttcgggagcgggaagccatcggaggccagcgagccatgccccacggagctcctgaaggcccgggaggactctgagtacctagtgaccctaaaacacgaggcccagcggctagagcggacggtggagcgcctcatcacggacaccgacagcttcctccatgatgcggggctgcggggtggtgcgcccttaccggggcctggcctccagggcgaagaggagcagggtgagggggaccagcaggagccccagctgctggggaccatcaacgccaagatgaaggctttcaagaaagagctgcaggccttcctgcagcaggtgaaccgcattggggatggcctatcccccttgccccacctcacagagtcctctagcttcctctccactgtgacttccgtgtcccgggactcccccatcgggaacctggggaaggagctgggcccagacttgcagtccagactgaaagagcagctggagtggcagctcgggccggcccaaggggacgagcgggagagcctgcgcctccgagccgcgcgggagctgcaccgccgcgcagacggggacaccgggagccacgggctgggaggccagacctgcttcagcctggagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcagttgcagaaagagaacagtccccggagaggtggcagtttcctctgtgatcaaaaagacggcaacgttcgcccctttccccaccagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggaagaagaaaatcacaaaggaaatcttcaaagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaaggggggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttcccggagccttaggagcagacaggtggcccctgccatcgagaaggtgcaggccaagtttgaacgcacatgctgctcccccaagtatggttctcccaagctgcagaggaagcccctccccaaagccgaccagccaaataacaggccaggaaacaggcaccaattcccgaggaaggtcgcctagccccattggggtggggtcagagatgtgcagggaggaagggggagagggcacgccagtgaagcaggacttatctgctccccctggctacaccctcactgagaacgtggcccggatcctcaacaagaagctgctggaacatgccttaaaggaggagaggaggcaggctgcccacgggcccccgggtctccacagtgacagccactcgctgggggacacagccgagccagggcccatggaggaactaccttgttctgcactagctcc

SEQ ID NO: 50 - protein, 1142 aa, Homo sapiens
MEDTRGQQEREGPGRDHAPSIPTSPFGDSLESSTELRRHLQFVEEEAELLRRSISEIEDHNRQLTHELSKFKFEPPREPGWLGEGASPGAGGGAPLQEELKSARLQISELSGKVLKLQHENHALLSNIQRCDLAAHLGLRAPSPRDSDAESDAGKKESDGEESRLPQPKREGPVGGESDSEEMFEKTSGFGSGKPSEASEPCPTELLKAREDSEYLVTLKHEAQRLERTVERLITDTDSFLHDAGLRGGAPLPGPGLQGEEEQGEGDQQEPQLLGTINAKMKAFKKELQAFLQQVNRIGDGLSPLPHLTESSSFLSTVTSVSRDSPIGNLGKELGPDLQSRLKEQLEWQLGPAQGDERESLRLRAARELHRRADGDTGSHGLGGQTCFSLEMEEEHLYALRWKELEMHSLALQNTLHERTWSDEKNLMQQELRSLKQNIFLFYVKLRWLLKHWRQGKQMEEEGEEFTEGEHPETLSRLGELGVQGGHQADGPDHDSDRGCGFPVGEHSPHSRVQIGDHSLRLQTADRGQPHKQVVENQQLFSAFKALLEDFRAELREDERARLRLQQQYASDKAAWDVEWAVLKCRLEQLEEKTENKLGELGSSAESKGALKKEREVHQKLLADSHSLVMDLRWQIHHSEKNWNREKVELLDRLDRDRQEWERQKKEFLWRIEQLQKENSPRRGGSFLCDQKDGNVRPFPHQGSLRMPRPVAMWPCADADSIPFEDRPLSKLKESDRCSASENLYLDALSLDDEPEEPPAHRPEREFRNRLPEEEENHKGNLQRAVSVSSMSEFQRLMDISPFLPEKGLPSTSSKEDVTPPLSPDDLKYIEEFNKSWDYTPNRGHNGGGPDLWADRTEVGRAGHEDSTEPFPDSSWYLTTSVTMTTDTMTSPEHCQKQPLRSHVLTEQSGLRVLHSPPAVRRVDSITAAGGEGPFPTSRARGSPGDTKGGPPEPMLSRWPCTSPRHSRDYVEGARRPLDSPLCTSLGFASPLHSLEMSKNLSDDMKEVAFSVRNAICSGPGELQVKDMACQTNGSRTMGTQTVQTISVGLQTEALRGSGVTSSPHKCLTPKAGGGATPVSSPSRSLRSRQVAPAIEKVQAKFERTCCSPKYGSPKLQRKPLPKADQPNNRPGNRHQFPRKVA

SEQ ID NO: 51 - DNA, 4080 bp, Homo sapiens
  CDS (140)...(4078)
cacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacacgcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagtgggaagggcctgttggcggggagagtgactcggaggagatgtttgagaagacgtcgggcttcgggagcgggaagccatcggaggccagcgagccatgccccacggagctcctgaaggcccgggaggactctgagtacctagtgaccctaaaacacgaggcccagcggctagagcggacggtggagcgcctcatcacggacaccgacagcttcctccatgatgcggggctgcggggtggtgcgcccttaccggggcctggcctccagggcgaagaggagcagggtgagggggaccagcaggagccccagctgctggggaccatcaacgccaagatgaaggctttcaagaaagagctgcaggccttcctggagcaggtgaaccgcattggggatggcctatcccccttgccccacctcacagagtcctctagcttcctctccactgtgacttccgtgtcccgggactcccccatcgggaacctggggaaggagctgggcccagacttgcagtccagactgaaagagcagctggagtggcagctcgggccggcccgaggggacgagcgggagagcctgcgcctccgagccgcgcgggagctgcaccgccgcgcagacggggacaccgggagccacgggctgggaggccagacctgcttcagcctggagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagaattgttgtggatatcccagaattaacattgaggaggagactttaggcttcaccaggctgccagctgggtccacggtaaaaacgttgaagagccttgggttgcagagattggagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggaagaagaaaatcacaaaggaaatcttcaaagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaaggggggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttcccggagccttaggagcagacaggtggcccctgccatcgagaaggtgcaggccaagtttgaacgcacatgctgctcccccaagtatggttctcccaagctgcagaggaagcccctccccaaagccgaccagccaaataacaggacgtcaccagggatggcccagaaagggtacagtgagtcagcctgggcccgctccaccaccacaagggagagccccgtgcacaccaccattaatgatggcctctccagcctcttcaacatcattgaccacagccccgtggtgcaggaccccttccagaaggggctgcgggccggcagtcggtctcgctcagcagagccccgaccagagctgggcccaggccaggaaacaggcaccaattcccgaggaaggtcgcctagccccattggggtggggtcagagatgtgcagggaggaagggggagagggcacgccagtgaagcaggacttatctgctccccctggctacaccctcactgagaacgtggcccggatcctcaacaagaagctgctggaacatgccttaaaggaggagaggaggcaggctgcccacgggcccccgggtctccacagtgacagccactcgctgggggacacagccgagccagggcccatggaggaactaccttgttctgcactagctcc

SEQ ID NO: 52 - protein, 1313 aa, Homo sapiens
MEDTRGQQEREGPGRDHAPSIPTSPFGDSLESSTELRRHLQFVEEEAELLRRSISEIEDHNRQLTHELSKFKFEPPREPGWLGEGASPGAGGGAPLQEELKSARLQISELSGKVLKLQHENHALLSNIQRCDLAAHLGLRAPSPRDSDAESDAGKKESDGEESRLPQPKWEGPVGGESDSEEMFEKTSGFGSGKPSEASEPCPTELLKAREDSEYLVTLKHEAQRLERTVERLITDTDSFLHDAGLRGGAPLPGPGLQGEEEQGEGDQQEPQLLGTINAKMKAFKKELQAFLEQVNRIGDGLSPLPHLTESSSFLSTVTSVSRDSPIGNLGKELGPDLQSRLKEQLEWQLGPARGDERESLRLRAARELHRRADGDTGSHGLGGQTCFSLEMEEEHLYALRWKELEMHSLALQNTLHERTWSDEKNLMQQELRSLKQNIFLFYVKLRWLLKHWRQGKQMEEEGEEFTEGEHPETLSRLGELGVQGGHQADGPDHDSDRGCGFPVGEHSPHSRVQIGDHSLRLQTADRGQPHKQVVENQQLFSAFKALLEDFRAELREDERARLRLQQQYASDKAAWDVEWAVLKCRLEQNCCGYPRINIEEETLGFTRLPAGSTVKTLKSLGLQRLELEEKTENKLGELGSSAESKGALKKEREVHQKLLADSHSLVMDLRWQIHHSEKNWNREKVELLDRLDRDRQEWERQKKEFLWRIEQGSLRMPRPVAMWPCADADSIPFEDRPLSKLKESDRCSASENLYLDALSLDDEPEEPPAHRPEREFRNRLPEEEENHKGNLQRAVSVSSMSEFQRLMDISPFLPEKGLPSTSSKEDVTPPLSPDDLKYIEEFNKSWDYTPNRGHNGGGPDLWADRTEVGRAGHEDSTEPFPDSSWYLTTSVTMTTDTMTSPEHCQKQPLRSHVLTEQSGLRVLHSPPAVRRVDSITAAGGEGPFPTSRARGSPGDTKGGPPEPMLSRWPCTSPRHSRDYVEGARRPLDSPLCTSLGFASPLHSLEMSKNLSDDMKEVAFSVRNAICSGPGELQVKDMACQTNGSRTMGTQTVQTISVGLQTEALRGSGVTSSPHKCLTPKAGGGATPVSSPSRSLRSRQVAPAIEKVQAKFERTCCSPKYGSPKLQRKPLPKADQPNNRTSPGMAQKGYSESAWARSTTTRESPVHTTINDGLSSLFNIIDHSPVVQDPFQKGLRAGSRSRSAEPRPELGPGQETGTNSRGRSPSPIGVGSEMCREEGGEGTPVKQDLSAPPGYTLTENVARILNKKLLEHALKEERRQAAHGPPGLHSDSHSLGDTAEPGPMEELPCSALA

SEQ ID NO: 53 - DNA, 2333 bp, Homo sapiens
  CDS (3)...(1658)
acaactgtctgctgcgcccgaaaaacaagtcggtgcgctggggacccggggccggggccgccttactccggcctagccccgcggccctcggtgcgggctccagggcatgctcggtaccccccgcggctccagcccagacgccccggcctcaggtctcggcccccgcttggggccccggccgtgcggcgcgagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatt

SEQ ID NO: 54 - protein, 551 aa, Homo sapiens
NCLLRPKNKSVRWGPGAGAALLRPSPAALGAGSRACSVPPAAPAQTPRPQVSAPAWGPGRAARGSGRMERRMKAGYLDQQVPYTFSSKSPGNGSLREALIGPLGKLMDPGSLPPLDSEDLFQDLSHFQETWLAEAQVPDSDEQFVPDFHSENLAFHSPTTRIKKEPQSPRTDPALSCSRKPPLPYHHGEQCLYSSAYDPPRQIAIKSPAPGALGQSPLQPFPRAEQRNFLRSSGTSQPHPGHGYLGEHSSVFQQPLDICHSFTSQGGGREPLPAPYQHQLSEPCPPYPQQSFKQEYHDPLYEQAGQPAVDQGGVNGHRYPGAGVVIKQEQTDFAYDSDVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 55 - DNA, 2702 bp, Homo sapiens
  CDS (170)...(1462)
gagcagcgcggtgggtgcggctgtgagacggcaggagacttctgccccgcggtgcacgcgaccctcgagacgacagcgcggctactgccagcagcgaaggcgcctcccgcggagcgccccgacggcgcccgctcgcccatgccgagctgagcgcggcagcggcggcgggatgctggcgctgctggccgccagcgtggcgctcgccgtggccgctggggcccaggacagcccggcgcccggtagccgcttcgtgtgcacggcactgcccccagaggcggtgcacgccggctgcccgctgcccgcgatgcccatgcagggcggcgcgcagagtcccgaggaggagctgagggccgcggtgctgcagctgcgcgagaccgtcgtgcagcagaaggagacgctggccagcgcgagggccatccgcgagctcacgggcaagctagcgcgctgcgaggggctggcgggcggcaaggcgcgcggcgcgggggccacgggcaaggacactatgggcgacctgccgcgggaccccggccacgtcgtggagcagctcagccgctcgctgcagaccctcaaggaccgcctggagagcctcgagcaccagctcagagcaaacgtgtccaatgctgggctgcccggcgacttccgcgaggtgctccagcagcggctgggggagctggagaggcagcttctgcgcaaggtggcagagctggaggacgagaagtccctgctgcacaatgagacctcggctcaccggcagaagaccgagagcaccctgaacgcgctgctgcagagggtcaccgagctggagcgaggcaatagcgcctttaagtcaccagatgcgttcaaggtgtccctcccactccgcacaaactacctatacggcaagatcaagaagacgctgcctgagctgtacgccttcaccatctgcctgtggctgcggtccagcgcctcaccaggcattggcacccccttctcctatgcggtgccagggcaggccaacgagatcttgctgatcgagtggggcaacaaccccatcgagctgctcatcaacgacaaggttgcgcagctgcccctgtttgtcagtgacggcaagtggcaccacatctgtgtcacctggacgacacgggatggcatgtgggaggcattccaggacggagagaagctgggcactggggagaacctggccccctggcaccccatcaagcccgggggcgtgctgatccttggacaagagcaggacaccgtggggggtaggtttgatgccactcaggcatttgtcggggagctcagccagttcaacatatgggaccgcgtccttcgcgcacaagaaattgtcaacatcgccaactgctccacaaacatgccgggcaacatcatcccgtgggtggacaataacgtcgatgtgttcggaggggcctccaagtggcccgtggagacgtgtgaggaggctctccttgacttgtagccgccttctcctctgtccaggaggccgggatcaggctgttgccatggaagttcagggccatagactgccccacttaaactcttgtcagtctgggctcagggttcccagagctcattccccaggaatctctaagaccagggctggggcagtgtctgtcactggcttgtttgttccctaccaatattctgttgctgtttgaagtagtgccagggtcccctgggaagatgcccccaagacacctgccccaagtgggtggatatctgccttcctgctgcaagtggaggcaggtccagcagcccctcttcagagcccctgtaaatgctatcgcagcctgagtcctgccgccttccagttccttggtgtcccgtgcaccccttctgtctgtcccctttcatgctgtgcagccgtcccgctggagtggccatgtcccttgtgcattgagtgcatccccgctggtgactaagctcgcagcaagcgctacccccgatctgcaaaagggcctctccctttgtgttctatacattgtgaatcttcccgtctgaagaacgcccagcctgcccagacaaagccccgccttccccaaagcagaggggctgtctgtgtctccagaaaggggacatcggggggggaggggggctcagaaaggagaagggctgtgatctccggtcccttcccccatcatccttccttagactgatgctttgactgaatcatcactagctatggcattaaaaggcctctcttctcatctggtgccaaaggttccgttgcagctttttacaaccatccggtgtggtttggaggatttgttttttttttttcccaacagaaaagaacagccattagaagaaggctcccattttctgatgttccgccccactgtgaagagtgtgctcgttttaaattcatgttgattcttgtaagcactggactgtcttcatcaagtatttcccctacagaactcctcaagaaaaacagagatcatttggctagagattgtctgagtgactccaagctactcactgtattggacgggagtagtaatttattttaaagataaagtgactaagtggggaaatttataaagctaaatattatatattttatttttcatacatgtttgaagtgcaaatctgtggatattccatttgtaggaccaagtcgacatgcccatcctgacattgtatgctacgagaactcttctgatgatggaatttcgattaaagtgcactgaaagatg

SEQ ID NO: 56 - protein, 430 aa, Homo sapiens [sequence omitted]

SEQ ID NO: 57 - DNA, 1679 bp, Homo sapiens
  CDS (60)...(1562)
ctgctgctgcggcggcggcggcggtggtggcggcggtggggtggcgggagcggagcggcatggccacggcggcttctaacccctacctgccggggaacagcctgctcgcggccggctctattgtgcactcggacgcggcgggggctggcggcggcgggggtggcggcggcggcagcggcgggggcggcgcagggggcgggggcggcggcatgcagccgggcagcgccgccgtgacctcgggcgcctaccggggggacccgtcctctgtcaagatggtccagagcgacttcatgcagggggccatggccgccagcaacggcggccatatgctgagccacgcgcaccagtgggtcacagccctgccccacgccgccgccgccgccgccgctgccgccgccgccgccgtggaggcgagctcgccgtggtcgggcagcgccgtgggcatggctggcagcccccagcagccaccgcagccgccgccgccaccgccgcagggccccgacgtgaagggcggcgccgggcgcgacgacctgcacgcgggcacagcgctgcaccaccgcgggccgccgcacctcggacccccgccgccgcccccacaccagggccaccctgggggctggggggcggccgccgctgccgcagccgcagccgccgccgccgccgccgccgcgcacctcccgtccatggccgggggccagcagccgccgccgcagagtctgctctactcgcagcccggaggcttcacggtgaacggcatgctgagcgcgccaccggggcccggcggcggcggcggcggcgcgggcggtggagcccagagcttggtgcacccggggctggtgcgcggggacacgccagagctggccgagcaccaccaccaccaccaccaccacgcgcatcctcacccgccgcacccgcaccacgcgcagggacccccgcaccacggcggcggcggcggcggcgcggggcctggactcaacagccacgacccgcactcggacgaggacacgccgacgtcggacgacctggagcagttcgccaagcagttcaagcagcggcgcatcaagctgggcttcacgcaggccgacgtggggttggcgctgggcacactctacggcaacgtgttctcgcagaccaccatctgccgcttcgaggccctgcagctgagcttcaagaacatgtgcaagctcaagccgctgctgaacaagtggctggaggaggcggactcaagcaccggcagccccacaagcatcgacaagatcgcggcgcagggtcgcaagcgcaagaagcggacctctatcgaggtgagcgtcaagggcgcgctggagagccacttcctcaagtgccccaagccctccgcgcaggagatcaccaacctggccgacagcctgcagctcgagaaggaggtggtgcgggtctggttctgcaatcggcgccaaaaggagaagcgcatgacgccgcccgggatccaacagcagacgcccgacgacgtctactcgcaggtgggcaccgtgagcgccgacacgccgccgcctcaccacgggctgcagacgagcgttcagtgaagccagggcgcagagcgaagagtgccgccgccgccgccgcctccgcagccgccgtcagcaccgccgccgcccctgccgccgccgccgccgccgccgccgccgctgccgccgccgcgc

SEQ ID NO: 58 - protein, 500 aa, Homo sapiens
MATAASNPYLPGNSLLAAGSIVHSDAAGAGGGGGGGGGSGGGGAGGGGGGMQPGSAAVTSGAYRGDPSSVKMVQSDFMQGAMAASNGGHMLSHAHQWVTALPHAAAAAAAAAAAAVEASSPWSGSAVGMAGSPQQPPQPPPPPPQGPDVKGGAGRDDLHAGTALHHRGPPHLGPPPPPPHQGHPGGWGAAAAAAAAAAAAAAAAHLPSMAGGQQPPPQSLLYSQPGGFTVNGMLSAPPGPGGGGGGAGGGAQSLVHPGLVRGDTPELAEHHHHHHHHAHPHPPHPHHAQGPPHHGGGGGGAGPGLNSHDPHSDEDTPTSDDLEQFAKQFKQRRIKLGFTQADVGLALGTLYGNVFSQTTICRFEALQLSFKNMCKLKPLLNKWLEEADSSTGSPTSIDKIAAQGRKRKKRTSIEVSVKGALESHFLKCPKPSAQEITNLADSLQLEKEVVRVWFCNRRQKEKRMTPPGIQQQTPDDVYSQVGTVSADTPPPHHGLQTSVQ

SEQ ID NO: 59 - DNA, 2495 bp, Homo sapiens
  CDS (84)...(938)
ccacgcgtccggcgcgggcgcgggcgcgggcgcgtgcgggctgcgagccgggaggcggcggcggcgacggcgacggcggcggcatggcggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccggcaccagcttgctgcaggaggtggtctacttggtgagccagggcgctgaccccgatgagatcggcttgatgaacatcgacgagcagctcccggtcctggagtacccacagccgggcctggacatcatcaaggaactgacctctccccgcctcatcaagagccacctgccctaccgctttctgccctctgacctccacaatggagactccaaggtcatctatatggctcgcaaccccaaggatctggtggtgtcttattatcagttccaccgctctctgcggaccatgagctaccgaggcacctttcaagaattctgccggaggtttatgaatgataagctgggctacggctcctggtttgagcacgtgcaggagttctgggagcaccgcatggactcgaacgtgctttttctcaagtatgaagacatgcatcgggacctggtgacgatggtggagcagctggccagattcctgggggtgtcctgtgacaaggcccagctggaagccctgacggagcactgccaccagctggtggaccagtgctgcaacgctgaggccctgcccgtgggccggggaagagttgggctgtggaaggacatcttcaccgtctccatgaatgagaagtttgacttggtgtataaacagaagatgggaaagtgtgacctcacgtttgacttttatttataataacagaaacaacaacctgcatgctcacaatacccagacagtctactagccaaaagtcctgtatgcattcatttattccttgctggacaaactctggaagcagcgtgtgaaacagcgggggaagggaagagcggcgtgagcggagggagtgtgatgattcccaaccgaaagcagctgtctcgcctttagaacgtgcagcctctccatgtctgattacaaacagtctccacattgcagttccaatggcctggaccgtaaggataaagcctgtaatatatgcaactagaatgtctgccttttcaaccccgtattatttattgtattttatagagcttttcactggaaatctacataaatgtcagtaaaccaaataaaagttcatttccaaggggaatcaggagcgagccacacccgaatggtagaaagatctcagggttaactctttatttttgtagttttattatctaaggcacagccattctgttctcacttggttctgagatagtggtgagaacagaggatgagttgggtctgttggggggaatctggacacttgtttattctgacggagttcacttcttcagaaccttcctgaaatgagcagaaattgttcactaggtcttcagaatggacgtccttctgccagagacttccagcgggcggctccaaaggcccaatgcagaggagcccgcggagcatgtgctgagggaagtctgcctggtgaggctggcaggtgggagtctaatgcagtcaggagcatttgcatgcagtgggtggagagtcggccaccaaaggaccgagttgcgctcggaatttgagctgaattccacagccttactttgtttcctgaagtgatagcctactaatgctggcaagcagatgcttaatagtaaatttctaaaatccccgggtctttatcattcagtttgttctgtgcacctgaggcgctcagccgtgggaggaccattttgcgagtgtagccctgtttcactcggatcaggttggcacggccgcctgcgtgtctgtccacctcatccctccgtgtatctgagggagtaaaggtgaggtctttattgcttcactgcctaattttctcacccacattcgctgaagcgatggagagtcgggggccagtagccagccaaccccgtggggaccggggttgtctgtcatttatgtggctggaaagcacccaaagtggtggtcaggagggtcgctgctgtggaaggggtctccgttcttggtgctgtatttgaaacgggtgtagagagaagcttgtgtttttgtttgtaatggggagaagcgtggccaggcagtggcacgtggcatcgcatggtgggctcggcagcaccttgcctgtgtttctgtgagggaggctgctttctgtgaaatttctttatatttttctatttttagtactgtatggatgttactgagcactacacatgatccttctgtgcttgcttgcatctttaataaagacatgttcccggcaaaaaaaaaaaaaaaaaaaaaaaaaaaaaaaaaaaaaaaaaaaaaaaaaaaaaaaaaaaaaaa

SEQ ID NO: 60 - protein, 284 aa, Homo sapiens
MAESEAETPSTPGEFESKYFEFHGVRLPPFCRGKMEEIANFPVRPSDVWIVTYPKSGTSLLQEVVYLVSQGADPDEIGLMNIDEQLPVLEYPQPGLDIIKELTSPRLIKSHLPYRFLPSDLHNGDSKVIYMARNPKDLVVSYYQFHRSLRTMSYRGTFQEFCRRFMNDKLGYGSWFEHVQEFWEHRMDSNVLFLKYEDMHRDLVTMVEQLARFLGVSCDKAQLEALTEHCHQLVDQCCNAEALPVGRGRVGLWKDIFTVSMNEKFDLVYKQKMGKCDLTFDFYL

SEQ ID NO: 61 - protein, 180 aa, Homo sapiens [sequence omitted]

SEQ ID NO: 62 - protein, 228 aa, Homo sapiens [sequence omitted]

SEQ ID NO: 63 - protein, 1328 aa, Homo sapiens; identical to SEQ ID NO: 24

SEQ ID NO: 64 - protein, 1021 aa, Homo sapiens; identical to SEQ ID NO: 26

SEQ ID NO: 65 - protein, 266 aa, Homo sapiens; identical to SEQ ID NO: 28

SEQ ID NO: 66 - protein, 123 aa, Homo sapiens; identical to SEQ ID NO: 30

SEQ ID NO: 67 - protein, 358 aa, Homo sapiens; identical to SEQ ID NO: 32

SEQ ID NO: 68 - protein, 222 aa, Homo sapiens; identical to SEQ ID NO: 34

SEQ ID NO: 69 - protein, 227 aa, Homo sapiens; identical to SEQ ID NO: 36

SEQ ID NO: 70 - protein, 224 aa, Homo sapiens; identical to SEQ ID NO: 38

SEQ ID NO: 71 - protein, 190 aa, Homo sapiens; identical to SEQ ID NO: 40

SEQ ID NO: 72 - protein, 342 aa, Homo sapiens; identical to SEQ ID NO: 42

SEQ ID NO: 73 - protein, 372 aa, Homo sapiens; identical to SEQ ID NO: 44

SEQ ID NO: 74 - protein, 748 aa, Homo sapiens; identical to SEQ ID NO: 46

SEQ ID NO: 75 - protein, 1307 aa, Homo sapiens; identical to SEQ ID NO: 48

SEQ ID NO: 76 - protein, 1142 aa, Homo sapiens; identical to SEQ ID NO: 50

SEQ ID NO: 77 - protein, 1313 aa, Homo sapiens; identical to SEQ ID NO: 52

SEQ ID NO: 78 - protein, 551 aa, Homo sapiens; identical to SEQ ID NO: 54

SEQ ID NO: 79 - protein, 430 aa, Homo sapiens [sequence omitted]

SEQ ID NO: 80 - protein, 500 aa, Homo sapiens; identical to SEQ ID NO: 58

SEQ ID NO: 81 - protein, 284 aa, Homo sapiens; identical to SEQ ID NO: 60

SEQ ID NO: 82 - protein, 228 aa, Homo sapiens [sequence omitted]

SEQ ID NO: 83 - protein, 210 aa, Homo sapiens
KQVKENKTQPPVAYQYWPPAELQYRPPPESQYGYPGMPPAPQGRAPYPQPPTRRLNPTAPPSRQGSELHEIIDKSRKEGDTEAWQFPITLEPMPPGEGAQEGEPPTVEARYKSFSIKMLKDMKEGVKQYGPNSPYMRTLLDSIAYGHRLIPYDWEILAKSSLSPSQFLQFKTWWIDGVQEQVRRNRAANPPVNIDADQLLGIGQNWSTIS

SEQ ID NO: 84 - protein, 796 aa, Homo sapiens
ANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLDACILTQGDKISLQEPLDYLLCCIQHCLAWYKNTVIPLQQGEEEEEEEEAFYEDLDDILESITNRMIKSELEDFELDKSADFSQSTSIGIKNNISAFLVMGVCEVLIEYNFSISSFSKNRFEDILSLFMCYKKLSDILNEKAGKAKTKMANKTSDSLLSMKFVSSLLTALFRDSIQSHQESLSVLRSSNEFMRYAVNVALQKVQQLKETGHVSGPDGQNPEKIFQNLCDITRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPA

SEQ ID NO: 85 - protein, 796 aa, Homo sapiens
ASQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLEACILTQGDKISLQEPLDYLLCCIQHCLAWYKNTVIPLQQGEEEEEEEEAFYEDLDDILESITNRMIKSELEDFELDKSADFSQSTSIGIKNNISAFLVMGVCEVLIEYNFSISSFSKNRFEDILSLFMCYKKLSDILNEKAGKAKTKMANKTSDSLLSMKFVSSLLTALFRDSIQSHQESLSVLRSSNEFMRYAVNVALQKVQQLKETGHVSGPDGQNPEKIFQNLCDLTRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPA

SEQ ID NO: 86 - protein, 1011 aa, Homo sapiens
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVCYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRP

SEQ ID NO: 87 - protein, 1011 aa, Homo sapiens
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRP

SEQ ID NO: 88 - protein, 288 aa, Homo sapiens
RNKTSFIFYLKNIVVADLIMTLTFPFRIVHDAGFGPWYFKFILCRYTSVLFYANMYTSIVFLGLISIDRYLKVVKPFGDSRMYSITFTKVLSVCVWVIMAVLSLPNIILTNGQPTEDNIHDCSKLKSPLGVKWHTAVTYVNSCLFVAVLVILIGCYIAISRYIHKSSRQFISQSSRKRKHNQSIRVVVAVFFTCFLPYHLCRIPFTFSHLDRLLDESAQKILYYCKEITLFLSACNVCLDPIIYFFMCRSFSRRLFKKSNIRTRSESIRSLQSVRRSEVRIYYDYTDV

SEQ ID NO: 89 - protein, 288 aa, Homo sapiens; identical to SEQ ID NO: 88

SEQ ID NO: 90 - protein, 222 aa, Homo sapiens; identical to SEQ ID NO: 34

SEQ ID NO: 91 - protein, 222 aa, Homo sapiens; identical to SEQ ID NO: 34

SEQ ID NO: 92 - protein, 227 aa, Homo sapiens; identical to SEQ ID NO: 36

SEQ ID NO: 93 - protein, 227 aa, Homo sapiens; identical to SEQ ID NO: 36

SEQ ID NO: 94 - protein, 190 aa, Homo sapiens; identical to SEQ ID NO: 40

SEQ ID NO: 95 - protein, 190 aa, Homo sapiens; identical to SEQ ID NO: 40

SEQ ID NO: 96 - protein, 342 aa, Homo sapiens; identical to SEQ ID NO: 42

SEQ ID NO: 97 - protein, 342 aa, Homo sapiens; identical to SEQ ID NO: 42

SEQ ID NO: 98 - protein, 372 aa, Homo sapiens; identical to SEQ ID NO: 44

SEQ ID NO: 99 - protein, 372 aa, Homo sapiens; identical to SEQ ID NO: 44

SEQ ID NO: 100 - protein, 551 aa, Homo sapiens; identical to SEQ ID NO: 54

SEQ ID NO: 101 - protein, 551 aa, Homo sapiens; identical to SEQ ID NO: 54

SEQ ID NO: 102 - protein, 430 aa, Homo sapiens [sequence omitted]

SEQ ID NO: 103 - protein, 284 aa, Homo sapiens; identical to SEQ ID NO: 60

SEQ ID NO: 104 - protein, 284 aa, Homo sapiens; identical to SEQ ID NO: 60

SEQ ID NO: 105 - protein, 500 aa, Homo sapiens; identical to SEQ ID NO: 58

SEQ ID NO: 106 - protein, 500 aa, Homo sapiens
MATAASNPYLPGNSLLAAGSIVHSDAAGAGGGGGGGGGGGGGGAGGGGGGMQPGSAAVTSGAYRGDPSSVKMVQSDFMQGAMAASNGGHMLSHAHQWVTALPHAAAAAAAAAAAAVEASSPWSGSAVGMAGSPQQPPQPPPPPPQGPDVKGGAGRDDLHAGTALHHRGPPHLGPPPPPPHQGHPGGWGAAAAAAAAAAAAAAAAHLPSMAGGQQPPPQSLLYSQPGGFTVNGMLSAPPGPGGGGGGAGGGAQSLVHPGLVRGDTPELAEHHHHHHHHAHPHPPHPHHAQGPPHHGGGGGGAGPGLNSHDPHSDEDTPTSDDLEQFAKQFKQRRIKLGFTQADVGLALGTLYGNVFSQTTICRFEALQLSFKNMCKLKPLLNKWLEEADSSTGSPTSIDKIAAQGRKRKKRTSIEVSVKGALESHFLKCPKPSAQEITNLADSLQLEKEVVRVWFCNRRQKEKRMTPPGIQQQTPDDVYSQVGTVSADTPPPHHGLQTSVQ

SEQ ID NO: 107 - protein, 1307 aa, Homo sapiens; identical to SEQ ID NO: 48

SEQ ID NO: 108 - protein, 1307 aa, Homo sapiens; identical to SEQ ID NO: 48

SEQ ID NO: 109 - protein, 1130 aa, Homo sapiens
MEDTRGQQEREGPGRDHAPSIPTSPFGDSLESSTELRRHLQFVEEEAELLRRSISEIEDHNRQLTHELSKFKFEPPREPGWLGEGASPGAGGGAPLQEELKSARLQISELSGKVLKLQHENHALLSNIQRCDLAAHLGLRAPSPRDSDAESDAGKKESDGEESRLPQPKREGPVGGESDSEEMFEKTSGFGSGKPSEASEPCPTELLKAREDSEYLVTLKHEAQRLERTVERLITDTDSFLHDAGLRGGAPLPGPGLQGEEEQGEGDQQEPQLLGTINAKMKAFKKELQAFLQQVNRIGDGLSPLPHLTESSSFLSTVTSVSRDSPIGNLGKELGPDLQSRLKEQLEWQLGPAQGDERESLRLRAARELHRRADGDTGSHGLGGQTCFSLEMEEEHLYALRWKELEMHSLALQNTLHERTWSDEKNLMQQELRSLKQNIFLFYVKLRWLLKHWRQGKQMEEEGEEFTEGEHPETLSRLGELGVQGGHQADGPDHDSDRGCGFPVGEHSPHSRVQIGDHSLRLQTADRGQPHKQVVENQQLFSAFKALLEDFRAELREDERARLRLQQQYASDKAAWDVEWAVLKCRLEQLEEKTENKLGELGSSAESKGALKKEREVHQKLLADSHSLVMDLRWQIHHSEKNWNREKVELLDRLDRDRQEWERQKKEFLWRIEQLQKENSPRRGGSFLCDQKDGNVRPFPHQGSLRMPRPVAMWPCADADSIPFEDRPLSKLKESDRCSASENLYLDALSLDDEPEEPPAHRPEREFRNRLPEEEENHKGNLQRAVSVSSMSEFQRLMDISPFLPEKGLPSTSSKEDVTPPLSPDDLKYIEEFNKSWDYTPNRGHNGGGPDLWADRTEVGRAGHEDSTEPFPDSSWYLTTSVTMTTDTMTSPEHCQKQPLRSHVLTEQSGLRVLHSPPAVRRVDSITAAGGEGPFPTSRARGSPGDTKGGPPEPMLSRWPCTSPRHSRDYVEGARRPLDSPLCTSLGFASPLHSLEMSKNLSDDMKEVAFSVRNAICSGPGELQVKDMACQTNGSRTMGTQTVQTISVGLQTEALRGSGVTSSPHKCLTPKAGGGATPVSSPSRSLRSRQVAPAIEKVQAKFERTCCSPKYGSPKLQRKPLPKADQPNNR

SEQ ID NO: 110 - protein, 1130 aa, Homo sapiens
MEDTRGQQEREGPGRDHAPSIPTSPFGDSLESSTELRRHLQFVEEEAELLRRSISEIEDHNRQLTHELSKFKFEPPREPGWLGEGASPGAGGGAPLQEELKSARLQISELSGKVLKLQHENHALLSNIQRCDLAAHLGLRAPSPRDSDAESDAGKKESDGEESRLPQPKREGPVGGESDSEEMFEKTSGFGSGKPSEASEPCPTELLKAREDSEYLVTLKHEAQRLERTVERLITDTDSFLHDAGLRGGAPLPGPGLQGEEEQGEGDQQEPQLLGTINAKMKAFKKELQAFLEQVNRIGDGLSPLPHLTESSSFLSTVTSVSRDSPIGNLGKELGPDLQSRLKEQLEWQLGPARGDERESLRLRAARELHRRADGDTGSHGLGGQTCFSLEMEEEHLYALRWKELEMHSLALQNTLHERTWSDEKNLMQQELRSLKQNIFLFYVKLRWLLKHWRQGKQMEEEGEEFTEGEHPETLSRLGELGVQGGHQADGPDHDSDRGCGFPVGEHSPHSRVQIGDHSLRLQTADRGQPHKQVVENQQLFSAFKALLEDFRAELREDERARLRLQQQYASDKAAWDVEWAVLKCRLEQLEEKTENKLGELGSSAESKGALKKEREVHQKLLADSHSLVMDLRWQIHHSEKNWNREKVELLDRLDRDRQEWERQKKEFLWRIEQLQKENSPRRGGSFLCDQKDGNVRPFPHQGSLRMPRPVAMWPCADADSIPFEDRPLSKLKESDRCSASENLYLDALSLDDEPEEPPAHRPEREFRNRLPEEEENHKGNLQRAVSVSSMSEFQRLMDISPFLPEKGLPSTSSKEDVTPPLSPDDLKYIEEFNKSWDYTPNRGHNGGGPDLWADRTEVGRAGHEDSTEPFPDSSWYLTTSVTMTTDTMTSPEHCQKQPLRSHVLTEQSGLRVLHSPPAVRRVDSITAAGGEGPFPTSRARGSPGDTKGGPPEPMLSRWPCTSPRHSRDYVEGARRPLDSPLCTSLGFASPLHSLEMSKNLSDDMKEVAFSVRNAICSGPGELQVKDMACQTNGSRTMGTQTVQTISVGLQTEALRGSGVTSSPHKCLTPKAGGGATPVSSPSRSLRSRQVAPAIEKVQAKFERTCCSPKYGSPKLQRKPLPKADQPNNR

SEQ ID NO: 111 - protein, 224 aa, Homo sapiens; identical to SEQ ID NO: 38

SEQ ID NO: 112 - protein, 224 aa, Homo sapiens; identical to SEQ ID NO: 38

SEQ ID NO: 113 - protein, 717 aa, Homo sapiens
MTSQPLRLAEEYGPSPGESELAVNPFDGLPFSSRYYELLKQRQALPIWAARFTFLEQLESNPTGVVLVSGEPGSGKSTQIPQWCAEFALARGFQKGQVTVTQPYPLAARSLALRVADEMDLTLGHEVGYSIPQEDCTGPNTLLRFCWDRLLLQEVASTRGTGAWGVLVLDEAQERSVASDSLQGLLQDARLEKLPGDLRVVVVTDPALEPKLRAFWGNPPIVHIPREPGERPSPIYWDTIPPDRVEAACQAVLELCRKELPGDVLVFLPSEEEISLCCESLSREVESLLLQGLPPRVLPLHPDCGRAVQAVYEDMDARKVVVTHWLADFSFSLPSIQHVIDSGLELRSVYNPRIRAEFQVLRPISKCQAEARRLRARGFPPGSCLCLYPKSFLELEAPPLPQPRVCEENLSSLVLLLKRRQIAEPGECHFLDQPAPEALMQALEDLDYLAALDDDGDLSDLGVILSEFPLAPELAKALLASCEFDCVDEMLTLAAMLTAAPGFTRPPLSAEEAALRRALEHTDGDHSSLIQVYEAFIQSGADEAWCQARGLNWAALCQAHKLRGELLELMQRIELPLSLPAFGSEQNRRDLQKALVSGYFLKVARDTDGTGNYLLLTHKHVAQLSSYCCYRSRRAPARPPPWVLYHNFTISKDNCLSIVSEIQPQMLVELAPPYFLSNLPPSESRDLLNQLREGMADSTAGSKSSSAQEFRDPCVLQ

SEQ ID NO: 114 - protein, 701 aa, Homo sapiens [sequence omitted]

SEQ ID NO: 115 - DNA, 3975 bp, Homo sapiens
cggagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagtgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgggatcagcaatatgtaatccaacacacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagatgcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctctgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagggatagtatccaaagccaccaagaaagcctttctgttctcaggtccagcaatgagtttatgcgctatgcagtgaatgtagctctgcagaaagtacagcagctaaaggaaacagggcatgtgagtggccctgatggccaaaacccagaaaagatctttcagaacctctgtgacataactcgagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaatcccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggcgaagatgaaaatgaagagggcactgcatcagagcatgggggacagaacaaagaaccagccaagaagaaaaggaaaaaataaatgaaatgcctgagttaatgtg

SEQ ID NO: 116 - DNA, 3991 bp, Homo sapiens
cggagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagtgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaacacacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagatgcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctctgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcaggtccagcaatgagtttatgcgctatgcagtgaatgtagctctgcagaaagtacagcagctaaaggaaacagggcatgtgagtggccctgatggccaaaacccagaaaagatctttcagaacctctgtgacataactcgagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaatcccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggcgaagatgaaaatgaagagggcactgcatcagagcatgggggacagaacaaagaaccagccaagaagaaaaggaaaaaataaatgaaatgcctgagttaatgtg

SEQ ID NO: 117 - DNA, 3853 bp, Homo sapiens
cggagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagtgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaacacacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagatgcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctctgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaatcccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggcgaagatgaaaatgaagagggcactgcatcagagcatgggggacagaacaaagaaccagccaagaagaaaaggaaaaaataaatgaaatgcctgagttaatgtg

SEQ ID NO: 118 - DNA, 3845 bp, Homo sapiens
cggagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagtgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaacacacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagatgcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctctgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagggatagtatccaaagccaccaagaaagcctttctgttctcaggtccagcaatgagtttatgcgctatgcagtgaatgtagctctgcagaaagtacagcagctaaaggaaacagggcatgtgagtggccctgatggccaaaacccagaaaagatctttcagaacctctgtgacataactcgagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagtatctccaggtgtgtcagagctccggaggaatcccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggcgaagatgaaaatgaagagggcactgcatcagagcatgggggacagaacaaagaaccagccaagaagaaaaggaaaaaataaatgaaatgcctgagttaatgtg

SEQ ID NO: 119 - DNA, 3665 bp, Homo sapiens
cggagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagtgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaacacacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagatgcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctctgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagtatctccaggtgtgtcagagctccggaggaatcccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggcgaagatgaaaatgaagagggcactgcatcagagcatgggggacagaacaaagaaccagccaagaagaaaaggaaaaaataaatgaaatgcctgagttaatgtg

SEQ ID NO: 120 - protein, 1149 aa, Homo sapiens
MFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLDACILTQGDKISLQEPLDYLLCCIQHCLAWYKNTVIPLQQGEEEEEEEEAFYEDLDDILESITNRMIKSELEDFELDKSADFSQSTSIGIKNNISAFLVMGVCEVLIEYNFSISSFSKNRFEDILSLFMCYKKLSDILNEKAGKAKTKMANKTSDSLLSMKFVSSLLTALFRDSIQSHQESLSVLRSSNEFMRYAVNVALQKVQQLKETGHVSGPDGQNPEKIFQNLCDITRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPAKKKRKK

SEQ ID NO: 121 - protein, 1314 aa, Homo sapiens
MDQKILSLAAEKTADKLQEFLQTLREGDLTNLLQNQAVKGKVAGALLRAIFKGSPCSEEAGTLRRRKIYTCCIQLVESGDLQKEIVSEIIGLLMLEAHHFPGPLLVELANEFISAVREGSLVNGKSLELLPIILTALATKKENLAYGKGVLSGEECKKQLINTLCSGRWDQQYVIQHTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLDACILTQGDKISLQEPLDYLLCCIQHCLAWYKNTVIPLQQGEEEEEEEEAFYEDLDDILESITNRMIKSELEDFELDKSADFSQSTSIGIKNNISAFLVMGVCEVLIEYNFSISSFSKNRFEDILSLFMCYKKLSDILNEKAGKAKTKMANKTSDSLLSMKFVSSLLTALFRSSNEFMRYAVNVALQKVQQLKETGHVSGPDGQNPEKIFQNLCDITRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPAKKKRKK

SEQ ID NO: 122 - protein, 1268 aa, Homo sapiens
MDQKILSLAAEKTADKLQEFLQTLREGDLTNLLQNQAVKGKVAGALLRAIFKGSPCSEEAGTLRRRKIYTCCIQLVESGDLQKEIVSEIIGLLMLEAHHFPGPLLVELANEFISAVREGSLVNGKSLELLPIILTALATKKENLAYGKGVLSGEECKKQLINTLCSGRWDQQYVIQHTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLDACILTQGDKISLQEPLDYLLCCIQHCLAWYKNTVIPLQQGEEEEEEEEAFYEDLDDILESITNRMIKSELEDFELDKSADFSQSTSIGIKNNISAFLVMGVCEVLIEYNFSISSFSKNRFEDILSLFMCYKKLSDILNEKAGKAKTKMANKTSDSLLSMKFVSSLLTALFRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPAKKKRKK

SEQ ID NO: 123 - protein, 1155 aa, Homo sapiens
MDQKILSLAAEKTADKLQEFLQTLREGDLTNLLQNQAVKGKVAGALLRAIFKGSPCSEEAGTLRRRKIYTCCIQLVESGDLQKEIVSEIIGLLMLEAHHFPGPLLVELANEFISAVREGSLVNGKSLELLPIILTALATKKENLAYGKGVLSGEECKKQLINTLCSGRWDQQYVIQHTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLDACILTQGDKISLQEPLDYLLCCIQHCLAWYKNTVIPLQQGEEEEEEEEAFYEDLDDILESITNRMIKSELEDFELDKSADFSQSTSIGIKNNISAFLVMGVCEVLIEYNFSISSFSKNRFEDILSLFMCYKKLSDILNEKAGKAKTKMANKTSDSLLSMKFVSSLLTALFRDSIQSHQESLSVLRSSNEFMRYAVNVALQKVQQLKETGHVSGPDGQNPEKIFQNLCDITRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSVSPGVSELRRNPKKYGKAGEAVWFSSDPPVLFFHFLRTE

SEQ ID NO: 124 - protein, 1095 aa, Homo sapiens
MDQKILSLAAEKTADKLQEFLQTLREGDLTNLLQNQAVKGKVAGALLRAIFKGSPCSEEAGTLRRRKIYTCCIQLVESGDLQKEIVSEIIGLLMLEAHHFPGPLLVELANEFISAVREGSLVNGKSLELLPIILTALATKKENLAYGKGVLSGEECKKQLINTLCSGRWDQQYVIQHTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLDACILTQGDKISLQEPLDYLLCCIQHCLAWYKNTVIPLQQGEEEEEEEEAFYEDLDDILESITNRMIKSELEDFELDKSADFSQSTSIGIKNNISAFLVMGVCEVLIEYNFSISSFSKNRFEDILSLFMCYKKLSDILNEKAGKAKTKMANKTSDSLLSMKFVSSLLTALFRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSVSPGVSELRRNPKKYGKAGEAVWFSSDPPVLFFHFLRTE

SEQ ID NO: 125 - DNA, 4723 bp, Homo sapiens
cccctttctccccctcggttaagtccctccccctcgccattcaaaagggctggctcggcactggctccttgcagtcggcgaactgtcggggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattaggaaaatcctgttgcgaataagaaggattccacagatcacataccggagaggttttgcctcagctgctctcaactttgtaatcttgtgaagaagctgacaagcttggctgattgcagagcactatgaggactgaacgacagtgggttttaattcagatatttcaagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgactgattccaggacatcaactattgaaatctgcagtgagatataactttctaggaacaacaaaattccattccccttccaaaaaatttcaatgattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcacaataacagagtactctcatgctgtttctctgtttgctctgaatcaacagccatgatgtaatataaggctgtcttggtgtatacacttatggttaatatatcagtcatgaaacatgcaattacttgccctgtctgattgttgaataattaaaacattatctccaggagtttggaagtgagctgaactagccaaactactctctgaaaggtatccagggcaagagacatttttaagaccccaaacaaacaaaaaacaaaaccaaaacactctggttcagtgttttgaaaatattcactaacataatattgctgagaaaatcatttttattacccaccactctgcttaaaagttgagtgggccgggcgcggtggctcacgcctgtaatcccagcactttgggaggccgaggcgggtggatcacgaggtcaggagattgagaccatcctggctaacacggtgaaaccccatctccactaaaaatacaaaaaattagcctggcgtggtggcgggcgcctgtagtcccagctactcgggaggctgaggcaggagaatagcgtgaacccgggaggcggagcttgcagtgagccgagatggcgccactgcactccagcctgggtgacagagcaagactctgtctcaaaaagaaaaaaatgttcaatgatagaaaataattttactaggtttttatgttgattgtactcatgctgttccactccttttaattattaaaaagttatttttggctgggtgtggtggctcacacctgtaatcccagcactttgggaggccgaggtgggtggatcacctgaggtcaggagttcaagaccagtctggccaacat

SEQ ID NO: 126 - DNA, 9196 bp, Homo sapiens
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagcggaaatctgaagggaaagtggcaggaaagtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactttcatacctggactaaagaaagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgcactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataacgttaaaaggtatacgtactctagcctttttttgggctttctttttgatttttgtttgttgttttcagtttttttgttgttgttagtgagtctcccttcaaaatacgcagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcctctttttactttaatagtttagtgtaaagtacatcagaaataaagctgtatctgccattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccatatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaacaagaaataccaataacacacacagaacaaaaaccatcaaaatctcatatatgaaataaaatatattcttctaagcaaagaaacagtactattcatagaaaacattagttttcttctgttgtctgttatttccttcttgtatcctcttaactggccattatcttgtatgtgcacattttataaatgtacagaaacatcaccaacttaattttcttccatagcaaaactgagaaaataccttgtttcagtataacactaaaccaagagacaattgatgtttaatgggggcggttggggtgggggggggagtcaatatctcctattgattaacttagacatagattttgtaatgtataacttgatatttaatttatgattaaactgtgtgtaaattttgtaacataaactgtggtaattgcataatttcattggtgaggatttccactgaatattgagaaagtttcttttcatgtgcccagcaggttaagtagcgttttcagaatatacattattcccatccattgtaaagttccttaagtcatatttgactgggcgtgcagaataacttcttaacttttaactatcagagtttgattaataaaattaattaatgttttttctccttcgtgttgttaatgttccaagggatttggagcatactggttttccaggtgcatgtgaatcccgaaggactgatgatatttgaatgtttattaaattattatcatacaaatgtgttgatattgtggctattgttgatgttgaaaattttaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaaactttagttttctgatgatctacacacacacacacacacacacgtgcacacacacacacatttaaatgatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgacgttttgacacctttcctatagatgatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttccttctctttctaagcgtccactaggtctggccttggaaacctgttacttctagggcttcagatctgatgatatctttttcatcacattacaagttatttctctgactgaatagacagtggtataggttgacacagcacacaagtggctattgtgatgtatgatgtatgtagtcctacaactgcaaaacgtcttactgaaccaacaatcaaaaaatggttctgttttaaaaaggattttgtttgatttgaaattaaaacttcaagctgaatgacttatatgagaataatacgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaatccttttcaatcctgagaaaattaaaggcgttttactcacatggctatttcaacattagttttttttgtttgtttctttttcatggtattactgaaggtgtgtatactccctaatacacatttatgaaaatctacttgtttaggcttttatttatactcttctgatttatattttttattataattattatttcttatctttcttcttttatattttttggaaaccaaatttatagttagtttaggtaaactttttattatgaccattagaaactattttgaatgcttccaactggctcaattggccgggaaaacatgggagcaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgattgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaaccatgctttggaagtaagaaggttgactattgtatggccaaggatggcagtatgtaatccagaagcaaacttgtattaattgttctatttcaggttctgtattgcatgttttcttattaatatatattaataaaagttatgagaaataaaaaaaaaaaaaaaaaaaa

SEQ ID NO: 127 - DNA, 9166 bp, Homo sapiens
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactttcatacctggactaaagaaagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgcactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataacgttaaaaggtatacgtactctagcctttttttgggctttctttttgatttttgtttgttgttttcagtttttttgttgttgttagtgagtctcccttcaaaatacgcagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcctctttttactttaatagtttagtgtaaagtacatcagaaataaagctgtatctgccattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccatatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaacaagaaataccaataacacacacagaacaaaaaccatcaaaatctcatatatgaaataaaatatattcttctaagcaaagaaacagtactattcatagaaaacattagttttcttctgttgtctgttatttccttcttgtatcctcttaactggccattatcttgtatgtgcacattttataaatgtacagaaacatcaccaacttaattttcttccatagcaaaactgagaaaataccttgtttcagtataacactaaaccaagagacaattgatgtttaatgggggcggttggggtgggggggggagtcaatatctcctattgattaacttagacatagattttgtaatgtataacttgatatttaatttatgattaaactgtgtgtaaattttgtaacataaactgtggtaattgcataatttcattggtgaggatttccactgaatattgagaaagtttcttttcatgtgcccagcaggttaagtagcgttttcagaatatacattattcccatccattgtaaagttccttaagtcatatttgactgggcgtgcagaataacttcttaacttttaactatcagagtttgattaataaaattaattaatgttttttctccttcgtgttgttaatgttccaagggatttggagcatactggttttccaggtgcatgtgaatcccgaaggactgatgatatttgaatgtttattaaattattatcatacaaatgtgttgatattgtggctattgttgatgttgaaaattttaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaaactttagttttctgatgatctacacacacacacacacacacacgtgcacacacacacacatttaaatgatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgacgttttgacacctttcctatagatgatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttccttctctttctaagcgtccactaggtctggccttggaaacctgttacttctagggcttcagatctgatgatatctttttcatcacattacaagttatttctctgactgaatagacagtggtataggttgacacagcacacaagtggctattgtgatgtatgatgtatgtagtcctacaactgcaaaacgtcttactgaaccaacaatcaaaaaatggttctgttttaaaaaggattttgtttgatttgaaattaaaacttcaagctgaatgacttatatgagaataatacgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaatccttttcaatcctgagaaaattaaaggcgttttactcacatggctatttcaacattagttttttttgtttgtttctttttcatggtattactgaaggtgtgtatactccctaatacacatttatgaaaatctacttgtttaggcttttatttatactcttctgatttatattttttattataattattatttcttatctttcttcttttatattttttggaaaccaaatttatagttagtttaggtaaactttttattatgaccattagaaactattttgaatgcttccaactggctcaattggccgggaaaacatgggagcaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgattgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaaccatgctttggaagtaagaaggttgactattgtatggccaaggatggcagtatgtaatccagaagcaaacttgtattaattgttctatttcaggttctgtattgcatgttttcttattaatatatattaataaaagttatgagaaataaaaaaaaaaaaaaaaaaaa

SEQ ID NO: 128 - DNA, 4061 bp, Homo sapiens
atggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagttagtgttactgatccaaatgccaaccacccagtctttaaggagccagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatgggaactccgatcctgaatctactttcatacctggactaaagaaagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataa

SEQ ID NO: 129 - DNA, 4860 bp, Homo sapiens
  misc_feature 4804: n = a, t, c, or g
ggcagtcggcgaactgtctgggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattagagggtgcttaaaaagtacagatcaactggatggatgaatggatggaagaggatggaatatcttaacaaaacacattttccttaagtaaattcatgcatactccaaataaaatacagaatgtgaagtatctctgaactgtgctgttgaatatggtagctactagctacatgaaaatcctgttgtgaataagaaggattccacagatcacataccagagcggttttgcctcagctgctctcaactttgtaatcttgtgaagaagctgacaagcttggctgattgcagtgcactatgaggactgaatgacagtgggttttaattcagatatttcaagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaattttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaagtgttcctcaagcagttcagatccctacagcgtttctgactgtggctatccagtgacaaccttcgaggtacctgtgtccgtacacaccagaccgactgattccaggacatgaactattgaaatctgcagtgagatgtaactttctaggaacaacaaaattccattccccttccaaaaaatttcaatggattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcacaataacagagtactctcatgctgtttctctgtttgctctgaatcaacagccatgatgtaatataaggctgtcttggtgtatacacttatggttaatatatcagtcatgaaacatgcaattacttgccctgtctgattgttgaataattaaaacattatcttccaggagtttggaagtgagctgaactagccaaactactctctgaaaggtatccagggcaagagacatttttaagaccccaaacaaacaaaaaacaaaaccaaaacactctggttcagtgttttgaaaatattcactaacataatattgctgagaaaatcatttttattacccaccactctgcttaaaagttgagtgggccgggcgcggtggctcacgcctgtaatcccagcactttgggaggccgaggcgggtggatcacgaggtcaggagattgagaccatcctggctaacacggtgaaaccccatctccactaaaaatacaaaaaattagcctggcgtggtggcgggcgcctgtagtcccagctactcgggaggctgaggcaggagaatagcgtgaacccgggaggcggagcttgcagtgagccgagatggcgccactctgcactccagcctgggtgacagagcaagactctgtctcaaaaagaaaaaaatgttcaatgatagaaaataattttactaggtttttatgttgattgtactcatggtgttccactccttttaattattaaaaagttatttttggggtgggtgtggtggctcacaccgtaatcccagcactttgggaggccgaggtgggtggatcacctgaggtcaggagttcaagaccagtntggccaacatggcgaaaccccgttttaaaaaaaaaaaaaaaaaaaaaaaagaaaaa

SEQ ID NO: 130 - DNA, 4220 bp, Homo sapiens
ggtggtccagtacctccaaagatatggaatacactcctgaaatatcctgaaaccttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcgttagtcacatcaacccctctcctctcccaaacttctcttcttcaaatcaaactttattagtccctcctttataatgattccttgcctccttttatccagatcaattttttttcactttgatgcccagagctgaagaaatggactattgtataaattattcattgccaagagaataattgcattttaaacccatgttataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacagatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccgactgattccaggacatgaactattgaaatctgcagtgagatgtaactttctaggaacaacaaaattccattccccttccaaaaaatttcaatgattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcgcaataacagagtactctcatgctgtttctctgtttgctctgaatcaacagccatgatgtaatataaggctgtcttggtgtatacacttatggttaat

SEQ ID NO: 131 - DNA, 8987 bp, Homo sapiens
ggtggtccagtacctccaaagatatggaatacactcctgaaatatcctgaaaccttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcgttagtcacatcaacccctctcctctcccaaacttctcttcttcaaatcaaactttattagtccctcctttataatgattccttgcctccttttatccagatcaattttttttcactttgatgcccagagctgaagaaatggactattgtataaattattcattgccaagagaataattgcattttaaacccatgttataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacagatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccgtcccagcggcgtgtcacatttcacctgccagaaggctctcaggaaagcagcagtgatggtggactgggagaccatgatgcaggcagccttaccagcacatcccatggcctgccccttggctatcctcaggaggagtactttgatcgtgctacacccagcaatcgcactgaaggggatggcaactccgatcctgaatctactttcatacctggactaaagaaagaaataactgttcaaccaactgtggaagaggcctctgacaactgcactcaagaatgtctcatctatggccattctgatgcctgctggatgccggcatctctggatcattccagctcttcacaagcacaggcctctgctctatgccacagcccaccactgtcacaggcctctactcagcaccacagcccaccagtgacacagaccattgttctctgccacagccctccagtgacacagaccatcgcattgtgccacagcccaccaccgatacaggtgtctgctctccaccacagtcctcctctagtgcagggtactgcacttcaccacagcccaccatcagcacaggcctcagccctctgctacagccctcctttagcacaggctgctgcaatcagccacagctcttctctgccacaggttattgccctccatcgtagtcaggcccaatcatcagtcagtttgcagcaaggttgggtgcaaggtgctaatggactatgctctgttgatcagggagtgcaaggtagtgcaacatctcagttttacaccatgtctgaaagacttcatcccagtgatgattcaattaaagtcattcctttgacaaccttcgctccacgccaacaggccagaccgtccagaggtgattcccccattatggaaacacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgtactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataatgttaaaaggtatacgtactctagccttttttggggctttctttttgatttttgtttgtggttttcagtttttttgttgttgttagtgagtctcccttcaaaatacacagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcccctttttactttaatagtttagtgtaaagtacatcagaaataaaactgtatctgacattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccacatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaagaagaaataccaataacacacacagaacaaaaaccatcaaaatctcatatatgaaataaaatatattcttctaagcaaagaaacagtactattcatagaaaacattagttttctcctgttgtctgttatttccttcttttatcctcttaactggccattatcttgtatgtgcacattttataaatgtacagaaacatcaccaacttgattttcttccatagcaaaactgagaaaataccttgtttcagtataacactaaaccaagagacaattgatgtttaatgggggcggttggggttgggggggagtcaatatctcctattgattaacttagacatagattttgtaatgtataacttgatatttaatttatgattaaactgtaattttgtaacataaactgtggtaattgcataatttcattggtgaggatttcctttgaatattgagaaagtttcttttcatgtgcccagcaggttaagtagcgttttcagaatatacattattcccatccattgtaaagttccttaagtcatatttgactgggcgtgcagaataacttcttaactattaactatcagagtttgattaataaaattaattaattttttttctccttcgtgttgttaatgttccaagggatttggagcatactggttttccaggtgcatgtgaatcccgaaggactgatgatatttgaatgtttattaaattattatcacacaaatgtgttgatattgtggctattgttgatgttgaaaattgtaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaacctttagttttctgatgatctacacacacacatacacacacacacacacacacgtgcacacacacacatttaaaggatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgaagttttgacacctttcctatagatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttctcttcctaagcgtccactaggtctggccttggaaatctgttacttctacggcttcagatctgatgatatctttttcatcacattacaagttatttctttgactgaatagacagtggtataggttgacacagcacacaagtggctattgtgatgtatgatgtatgtagtcccacaactgcaaaacgtcttactgaagcaacaatcgaaaaatggttctgttttaaaaaggattttgtttgatttgaaattaaaacttcaaactgaatgacttatatgagaataatatgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaaatccttttcaatcctgagaaaattaaaggtgttttactcacatggatatttcaacattagttttttttgtttgtttctttttcatggtattactgaaggtgtgtatactccctaatacacatttatgaaaatctacttgtttagacttttatttatactcttctgatttatattttttattataattattatttcttatcttcttttatattttttggaaaccaaatttatagttagtttaggtaaactttttattatgaccattagaaactattttgaatgtttccaactggctcaattggctgggaaaacatgggaacaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgactgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaagcatgctttggaagtaagaaggttgactattgtatggccaaggatggcagtatgtaatccagaagcaaacttgtattaattgttctatttcaggttct

SEQ ID NO: 132 - protein, 1025 aa, Homo sapiens
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPTDSRTSTIEICSEI

SEQ ID NO: 133 - protein, 1347 aa, Homo sapiens
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPPMKEVVRSCTPMKESTTMEIWIHPQPQRKSEGKVAGKSQRRVTFHLPEGSQESSSDGGLGDHDAGSLTSTSHGLPLGYPQEEYFDRATPSNRTEGDGNSDPESTFIPGLKKAAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPIMEEHPL

SEQ ID NO: 134 - protein, 1337 aa, Homo sapiens
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPPMKEVVRSCTPMKESTTMEIWIHPQPQSQRRVTFHLPEGSQESSSDGGLGDHDAGSLTSTSHGLPLGYPQEEYFDRATPSNRTEGDGNSDPESTFIPGLKKAAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPIMEEHPL

SEQ ID NO: 135 - protein, 1310 aa, Homo sapiens [sequence omitted]

SEQ ID NO: 136 - protein, 1037 aa, Homo sapiens [sequence omitted]

SEQ ID NO: 137 - protein, 1047 aa, Homo sapiens
MFRVGFLIISSSSSLSPLLLVSVVRVNTTNCHKCLLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVKILVAAVAGTITVVVVIFITAVVRCRQAPHLKAAQKNMQNSEWATPNPENRQMIMMKKKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPLDNTFVACDSISNCSSSSSDPYSVSDCGYPVTTFEVPVSVHTRPTDSRT

SEQ ID NO: 138 - protein, 1340 aa, Homo sapiens
MFRVGFLIISSSSSLSPLLLVSVVRVNTTNCHKCLLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVKILVAAVAGTITVVVVIFITAVVRCRQAPHLKAAQKNMQNSEWATPNPENRQMIMMKKKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPLDNTFVACDSISNCSSSSSDPYSVSDCGYPVTTFEVPVSVHTRPSQRRVTFHLPEGSQESSSDGGLGDHDAGSLTSTSHGLPLGYPQEEYFDRATPSNRTEGDGNSDPESTFIPGLKKEITVQPTVEEASDNCTQECLIYGHSDACWMPASLDHSSSSQAQASALCHSPPLSQASTQHHSPPVTQTIVLCHSPPVTQTIALCHSPPPIQVSALHHSPPLVQGTALHHSPPSAQASALCYSPPLAQAAAISHSSSLPQVIALHRSQAQSSVSLQQGWVQGANGLCSVDQGVQGSATSQFYTMSERLHPSDDSIKVIPLTTFAPRQQARPSRGDSPIMETHPL

SEQ ID NO: 139 - DNA, 722 bp, Homo sapiens
gaaggtcttggaaaaggcggtgttcattagaaatctcaaaaccgagtcaccaagttccctctgttggagcccagtggagcctctgggagaaaagctggggtgacttttcctacaaggggcagagggactctgctagatttttgtttttcatttgtttttaattttgtaacatggaaactctttccttaggatataccagctctcattactcagctaggaattatacctctttaaagcctgaatttaaaagtctgacagttttaaatgcttactaactgtgggagttaaatcattacgaagtgaggaatacagagtgttgtccctgattctgggtttaatctggtaagaatctttacagaggacgaccacacgccgcttcctgtagcatgtgtcgtggttgtaattctctcatgtgcatattaagaagttgctgctcagatgtggctcttccctttgcagaggccggtgccctcgaccgcctcctggatctccccgccgcagcctcctcagaagacatcgagcggtcctgagagcctcctgggcatgtttgtctgtgtgctgtaacctgaagtcaaaccttaagataatggataatcttcggccaatttatgcagagtcagccattcctgttctctttgccttgatgttgtgttgttatcatttaagattttttttttttggtaattattttgagtggcaaaataaagaatagcaattacttg

SEQ ID NO: 140 - protein, 47 aa, Homo sapiens
MCRGCNSLMCILRSCCSDVALPFAEAGALDRLLDLPAAASSEDIERS

SEQ ID NO: 141 - DNA, 1696 bp, Homo sapiens
gccgcccaggattccacgagggggaaggattctctattcttttttgcgacaaatctggtaacaggatttgctgtgctgttttcgtccgtgtgtgtgtgcgtgtgtgtgtgtgttcgtgtggatgcacgtgtggccccgctggggtgccccctccagtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaaggactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacagggtagtgctggaaccgcggagtttggctcaccgcaaagctacaacgatggactcttgcatagaaaaaaaaaatcttgttaacaatgaaaaaatgagcaaacaaaaaaatcgaaagacaaacgggagagaaaaagaggaaggcaacttatttcttaactgctatttggcagaagctgaaattggagaaccaaggagcaaaaacaaattttaaaattaaagtattttatacatttaaaaatatggaaaaacaacccagacgattctcgagagactggggggagttaccaacttaaatgtgtgttttaaaaaatgcgctaagaaggcaaagcagaaagaagaggtatacttatttaaaaaactaagatgaaaaaagtgcgcaggtgggaagttcacaggttttgaaactgacctttttctgcgaagttcacgttaatacgagaaatttgatgagagaggcgggcctccttttacgttgaatcagatgctttgagtttaaacccaccatgtatggaagagcaagaaaagagaaaatattaaaacgaggagagagaaaaataatggcaaaactgtctggactgctgacagtaaattccggtttgcatggaaaaaaaaaaaaaaaaaaaaaaaaaaa

SEQ ID NO: 142 - DNA, 1948 bp, Homo sapiens
gagcgccgggctgacgtgcggcggcgatggaagaacttacggcgttcgtctccaagtcttttgaccagaaagtgaaggagaagaaggaggcgatcacgtaccgggaggtgctggagagcgggccgctgcgcggggccaaggagccgaccggctgcaccgaggcgggccgcgacgaccgcagcagcccggcagtccgggcggccggcggaggcggcggcggaggaggcggaggcggcggcggaggaggcggaggaggtgtaggaggaggtggagcaggcggaggagctggaggagggcgctctcccgtccgggagctggacatgggcgccgccgagagaagcagggagcccggcagcccgcggctgacggaggtgtccccggagctgaaagatcgcaaagacgatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggatagtcattgcaacgtgacgcccttgccctttcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaaggactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacagggtagtgctggaaccgcggagtttggctcaccgcaaagctacaacgatggactcttgcatagaaaaaaaaaatcttgttaacaatgaaaaaatgagcaaacaaaaaaatcgaaagacaaacgggagagaaaaagaggaaggcaacttatttcttaactgctatttggcagaagctgaaattggagaaccaaggagcaaaaacaaattttaaaattaaagtattttatacatttaaaaatatggaaaaacaacccagacgattctcgagagactggggggagttaccaacttaaatgtgtgttttaaaaaatgcgctaagaaggcaaagcagaaagaagaggtatacttatttaaaaaactaagatgaaaaaagtgcgcaggtgggaagttcacaggttttgaaactgacctttttctgcgaagttcacgttaatacgagaaatttgatgagagaggcgggcctccttttacgttgaatcagatgctttgagtttaaacccaccatgtatggaagagcaagaaaagagaaaatattaaaacgaggagagagaaaaataatggcaaaactgtctggactgctgacagtaaattccggtttgcatggaaaaaaaaaaaaaaaaaaaaaaaaaaa

SEQ ID NO: 143 - protein, 190 aa, Homo sapiens
MEDEGQTKIKQRRSRTNFTLEQLNELERLFDETHYPDAFMREELSQRLGLSEARVQVWFQNRRAKCRKQENQLHKGVLIGAASQFEACRVAPYVNVGALRMPFQQVQAQLQLDSAVAHAHHHLHPHLAAHAPYMMFPAPPFGLPLATLAADSASAASVVAAAAAAKTTSKDSSIADLRLKAKKHAAALGL

SEQ ID NO: 144 - protein, 331 aa, Homo sapiens
MEELTAFVSKSFDQKVKEKKEAITYREVLESGPLRGAKEPTGCTEAGRDDRSSPAVRAAGGGGGGGGGGGGGGGGGGVGGGGAGGGAGGGRSPVRELDMGAAERSREPGSPRLTEVSPELKDRKDDAKGMEDEGQTKIKQRRSRTNFTLEQLNELERLFDETHYPDAFMREELSQRLGLSEARVQVWFQNRRAKCRKQENQLHKGVLIGAASQFEACRVAPYVNVGALRMPFQQDSHCNVTPLPFQVQAQLQLDSAVAHAHHHLHPHLAAHAPYMMFPAPPFGLPLATLAADSASAASVVAAAAAAKTTSKDSSIADLRLKAKKHAAALGL

SEQ ID NO: 145 - DNA, 2103 bp, Homo sapiens
cggatggggaaaaaaaaagatgtcagctcctccgctgtagtattgctccttaaaaacccctctctctgaaaatgacatgccctcgcaatgtaactccgaactcgtacgcggagcccttggctgcgcccggcggaggagagcgctatagccggagcgcaggcatgtatatgcagtctgggagtgacttcaattgcggggtgatgaggggctgcgggctcgccccctcgctctccaagagggacgagggcagcagccccagcctcgccctcaacacctatccgtcctacctctcgcagctggactcctggggcgaccccaaagccgcctatcgcctggaacaacctgttggcaggccgctgtcctcctgctcctacccacctagtgtcaaggaggagaatgtctgctgcatgtacagcgcagagaaccgggcgaaaagtggccctgaggcagctctctactcccaccccttgccggagtcctgccttggggagcacgaggtacccgtccccagctactaccgcgccagcccgagctactccgcgctggacaagacgccccactgttctggggccaacgacttcgaagcccctttcgagcagcgggccagtctcaacccgcgcgccgaacatctggaatcgcctcagctggggggcaaagtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaaggtaaggccgcctgggccgcgggcgccactgggacgttccggcacttggtcttcgcggccggggaggggggcaggggagagggttgggcccaggaggccccagaccatttcgggaatgcgaccctggctttcgactagcgtccgctgagctccaggctggtggcgcgtcacttagctggggaagaggagataaaggcagaaaacaccacaggaaattggctgactgcaaagagcggaaggaagaagaggtgcccctatactaaacaccagacgctggaattggagaaagaatttctgttcaatatgtatttgacgcgagagcgccgcctggagattagcaagaccattaaccttacagacagacaagtcaaaatctggtttcaaaatcgcagaatgaaactcaagaaaatgaaccgagagaatcggatccgggaactgacctccaattttaatttcacctgagagcgcggcctctcctcctcccttcccgctccttgctctccccgcccctcctccctttgtgcctggtgatatatttttttttcctccctgagtataaatgcaatgcgactgcaaaaaaggcaaagacctcagactctccttccaagggacctgtggttcgtgctgcgaagatgcttccacttaaagcatgagaaatggggtgccgggatgtggggtgtggtgtgtgccctcatagatgggggtgggagtgtggctggtgtgtgtgtcaaaccctcactcacccacgcactcacacacagcattctgttctccatgcaaagttaagatcgaatccatccgcttgtaggggaaaaaaaggaaaaaaattaaccagagagggtctgtaatctcgcagagcacaggcagaatcgttccttccttgctgcatttcctccttagactaatagacgttttggaaagttcggctagtgttcgtgtgtttgtcgtagcacccagagcctccaccaaaccctctccatgtctttacctcccagtcgctctaagatctgcttgaagtctcgtatttgtactgctttctgcttttctcccacccctcctagcacccccacatcccccatctagtaacatctcagaaatttcatccagaggaacaaaaaaattaaaaatagaacatagcaaagcaaagacagaatgcccccccccaaatattgtcctgtccctgtctgggagttgtgttatttaaagatattctgtatgttgtatcttttgcatgtagcttccttaatggagaaaaaaaaatcctaataaatttccagaatca

SEQ ID NO: 146 - protein, 295 aa, Homo sapiens
MTCPRNVTPNSYAEPLAAPGGGERYSRSAGMYMQSGSDFNCGVMRGCGLAPSLSKRDEGSSPSLALNTYPSYLSQLDSWGDPKAAYRLEQPVGRPLSSCSYPPSVKEENVCCMYSAENRAKSGPEAALYSHPLPESCLGEHEVPVPSYYRASPSYSALDKTPHCSGANDFEAPFEQRASLNPRAEHLESPQLGGKVSFPETPKSDSQTPSPNEIKTEQSLAGPKGSPSESEKERAKAADSSPDTSDNEAKGKAAWAAGATGTFRHLVFAAGEGGRGEGWAQEAPDHFGNATLAFD

SEQ ID NO: 147 - DNA, 2544 bp, Homo sapiens
gactacgtgggtctggagctgactgccgtcctgacacgtcctagagctgcaagcaggtcctgccagagagccaccatgacctctcagcctctcaggctagcagaagagtatggcccaagtcctggggagtctgaactggctgtgaacccctttgatgggcttcccttctcttcccgctactatgagctgctgaagcagcgccaagccttgcccatctgggctgctcgctttaccttcttggagcagttggagagtaaccccactggagtggtgctggtgtctggggagcctggttctggcaagagcacccagatccctcagtggtgtgcagagtttgcgctggccagagggttccagaaaggacaggttactgttactcagccctaccctcttgcagcccggagcctggctctgcgggttgctgatgagatggacctgaccctgggtcatgaggttggatacagcatcccccaggaggactgcacggggcccaacaccctgctcaggttctgctgggacaggctgcttctgcaggaggtggcctcgacccgaggcactggagcctggggcgtgctggtactagatgaggctcaggagcggtcggtggcatcagattcactccaggggctactgcaagatgccaggctggaaaaacttccgggggacctcagagtggttgtggttactgacccagcccttgaacctaagctccgagctttctggggcaatcctcctattgtgcatatacccagagagcctggtgagagaccttcccccatctactgggacaccatcccacctgatcgggtggaagctgcctgccaagcagtgcttgaattgtgtcggaaggagcttccaggagatgtgctagtgttcctgcccagtgaggaggaaatttccctgtgctgtgaatccttgtccagggaggtagagtccttgcttctccaagggcttccaccacgagtactgccccttcacccagactgtggacgagccgttcaggctgtgtatgaggacatggatgcccgaaaggttgtggtcactcactggctggctgacttctccttctccctcccttccatccaacatgtcatcgactcaggactggagctccgaagtgtttacaatcctaggatccgagcagaattccaagtgttgaggccaatcagcaagtgtcaggcagaggcaagacgattgcgagcaagagggttcccaccaggatcctgcctctgcctgtatcctaagtccttcttagaactagaagctccaccattgccacaacccagggtgtgtgaggagaatctgagctccctggtgttactactaaaaaggagacagattgcagagccaggggagtgtcacttcctggaccagcctgctccagaagcactgatgcaagccctggaagatttagactatctggcagccctggatgatgatggggacctgtcagatctgggtgtcatactatcagaattccctctggcccctgagctggccaaagccctgctggcctcatgcgagtttgactgtgtggacgagatgctcaccctggctgccatgctcacagctgcccctgggtttacccgtcctccactcagtgcagaagaagctgccctgcgtcgggccctggaacacacggatggtgaccacagttctctgatccaggtgtatgaagcctttatacaaagtggagcagatgaggcttggtgccaggctcgaggtctgaattgggcagcattgtgccaagcccataaacttcggggagaactcctagaactcatgcaacgaattgaacttcccttgtccctaccagcctttggctctgagcagaatcgcagagaccttcagaaagcactggtgtcaggatactttctcaaggtggccagagacacagacgggactggaaattaccttctcctaacccataagcatgtggcccagctctcctcatactgctgctaccgaagccgcagagctcctgccagacccccaccatgggtgctctaccacaatttcaccatatccaaagacaactgcctttccattgtttctgagattcaaccacagatgctggtggaattggcccctccatacttcctgagtaacttgcctcccagtgagagcagagaccttctgaaccagctaagggaaggaatggcagattctacagcagggagcaaatcatcctcagcccaggagttcagagatccctgtgtcctgcagtgacctgcctgcctatggaatggagctgggttcatctcatcacattagattatccctcagggtgacaccaaagcacccagacagatttagaagcccaaagtttagggtcaaatgtaaaccctggaacctgagtcccaagaaatggtagactgggaatggaaagaatggggtaaaccacagtctacatagggaaggactctttccttagccttctcttattgattggagagggactgacatgctcctcattctcttaactttgccaaacccattcttgtactcccttgtgatctataaaagatttttctatgatgccaa

SEQ ID NO: 148 - DNA, 2632 bp, Homo sapiens
ctgatggcgatgaatgaacactgcgtttgctgggaagatggtgtcggtcaccaaatatgaccttactggctgctctgccttctgcaggtcctgccagagagccaccatgacctctcagcctctcaggctagcagaagagtatggcccaagtcctggggagtctgaactggctgtgaacccctttgatgggcttcccttctcttcccgctactatgagctgctgaagcagcgccaagccttgcccatctgggctgctcgctttaccttcttggagcagttggagagtaaccccactggagtggtgctggtgtctggggagcctggttctggcaagagcacccagatccctcagtggtgtgcagagtttgcgctggccagagggttccagaaaggacaggttactgttactcagccctaccctcttgcagcccggagcctggctctgcgggttgctgatgagatggacctgaccctgggtcatgaggttggatacagcatcccccaggaggactgcacggggcccaacaccctgctcaggttctgctgggacaggctgcttctgcaggaggtggcctcgacccgaggcactggagcctggggcgtgctggtactagatgaggctcaggagcggtcggtggcatcagattcactccaggggctactgcaagatgccaggctggaaaaacttccgggggacctcagagtggttgtggttactgacccagcccttgaacctaagctccgagctttctggggcaatcctcctattgtgcatatacccagagagcctggtgagagaccttcccccatctactgggacaccatcccacctgatcgggtggaagctgcctgccaagcagtgcttgaattgtgtcggaaggagcttccaggagatgtgctagtgttcctgcccagtgaggaggtaaaaaaacaaaacaaaacaaaaaaaacagcctgcaaaatgagcctgcaaaaggaggaaatttccctgtgctgtgaatccttgtccagggaggtagagtccttgcttctccaagggcttccaccacgagtactgccccttcacccagactgtggacgagccgttcaggctgtgtatgaggacatggatgcccgaaaggttgtggtcactcactggctggctgacttctccttctccctcccttccatccaacatgtcatcgactcaggactggagctccgaagtgtttacaatcctaggatccgagcagaattccaagtgttgaggccaatcagcaagtgtcaggcagaggcaagacgattgcgagcaagagggttcccaccaggatcctgcctctgcctgtatcctaagtccttcttagaactagaagctccaccattgccacaacccagggtgtgtgaggagaatctgagctccctggtgttactactaaaaaggagacagattgcagagccaggggagtgtcacttcctggaccagcctgctccagaagcactgatgcaagccctggaagatttagactatctggcagccctggatgatgatggggacctgtcagatctgggtgtcatactatcagaattccctctggcccctgagctggccaaagccctgctggcctcatgcgagtttgactgtgtggacgagatgctcaccctggctgccatgctcacagctgcccctgggtttacccgtcctccactcagtgcagaagaagctgccctgcgtcgggccctggaacacacggatggtgaccacagttctctgatccaggtgtatgaagcctttatacaaagtggagcagatgaggcttggtgccaggctcgaggtctgaattgggcagcattgtgccaagcccataaacttcggggagaactcctagaactcatgcaacgaattgaacttcccttgtccctaccagcctttggctctgagcagaatcgcagagaccttcagaaagcactggtgtcaggatactttctcaaggtggccagagacacagacgggactggaaattaccttctcctaacccataagcatgtggcccagctctcctcatactgctgctaccgaagccgcagagctcctgccagacccccaccatgggtgctctaccacaatttcaccatatccaaagacaactgcctttccattgtttctgagattcaaccacagatgctggtggaattggcccctccatacttcctgagtaacttgcctcccagtgagagcagagaccttctgaaccagctaagggaaggaatggcagattctacagcagggagcaaatcatcctcagcccaggagttcagagatccctgtgtcctgcagtgacctgcctgcctatggaatggagctgggttcatctcatcacattagattatccctcagggtgacaccaaagcacccagacagatttagaagcccaaagtttagggtcaaatgtaaaccctggaacctgagtcccaagaaatggtagactgggaatggaaagaatggggtaaaccacagtctacatagggaaggactctttccttagccttctcttattgattggagagggactgacatgctcctcattctcttaactttgccaaacccattcttgtactcccttgtgatctataaaagatttttctatgatgccaa

SEQ ID NO: 149 - DNA, 2666 bp, Homo sapiens
ctgatggcgatgaatgaacactgcgtttgctgggaagatggtgtcggtcaccaaatatgaccttactggctgctctgccttctgcaggtcctgccagagagccaccatgacctctcagcctctcaggctagcagaagagtatggcccaagtcctggggagtctgaactggctgtgaacccctttgatgggcttcccttctcttcccgctactatgagctgctgaagcagcgccaagccttgcccatctgggctgctcgctttaccttcttggagcagttggagagtaaccccactggagtggtgctggtgtctggggagcctggttctggcaagagcacccagatccctcagtggtgtgcagagtttgcgctggccagagggttccagaaaggacaggttactgttactcagccctaccctcttgcagcccggagcctggctctgcgggttgctgatgagatggacctgaccctgggtcatgaggttggatacagcatcccccaggaggactgcacggggcccaacaccctgctcaggttctgctgggacaggctgcttctgcaggaggtggcctcgacccgaggcactggagcctggggcgtgctggtactagatgaggctcaggagcggtcggtggcatcagattcactccaggggctactgcaagatgccaggctggaaaaacttccgggggacctcagagtggttgtggttactgacccagcccttgaacctaagctccgagctttctggggcaatcctcctattgtgcatatacccagagagcctggtgagagaccttcccccatctactgggacaccatcccacctgatcgggtggaagctgcctgccaagcagtgcttgaattgtgtcggaaggagcttccaggagatgtgctagtgttcctgcccagtgaggaggaaatttccctgtgctgtgaatccttgtccagggaggtagagtccttgcttctccaagggcttccaccacgagtactgccccttcacccagactgtggacgagccgttcaggctgtgtatgaggacatggatgcccgaaaggttgtggtcactcactggctggctgacttctccttctccctcccttccatccaacatgtcatcgactcaggactggagctccgaagtgtgagtgagagagagagatagcggtggggtagtaaagacagaaatggcccactctgatctgtcttggccttggttgggggacgggcaacaggtttacaatcctaggatccgagcagaattccaagtgttgaggccaatcagcaagtgtcaggcagaggcaagacgattgcgagcaagagggttcccaccaggatcctgcctctgcctgtatcctaagtccttcttagaactagaagctccaccattgccacaacccagggtgtgtgaggagaatctgagctccctggtgttactactaaaaaggagacagattgcagagccaggggagtgtcacttcctggaccagcctgctccagaagcactgatgcaagccctggaagatttagactatctggcagccctggatgatgatggggacctgtcagatctgggtgtcatactatcagaattccctctggcccctgagctggccaaagccctgctggcctcatgcgagtttgactgtgtggacgagatgctcaccctggctgccatgctcacagctgcccctgggtttacccgtcctccactcagtgcagaagaagctgccctgcgtcgggccctggaacacacggatggtgaccacagttctctgatccaggtgtatgaagcctttatacaaagtggagcagatgaggcttggtgccaggctcgaggtctgaattgggcagcattgtgccaagcccataaacttcggggagaactcctagaactcatgcaacgaattgaacttcccttgtccctaccagcctttggctctgagcagaatcgcagagaccttcagaaagcactggtgtcaggatactttctcaaggtggccagagacacagacgggactggaaattaccttctcctaacccataagcatgtggcccagctctcctcatactgctgctaccgaagccgcagagctcctgccagacccccaccatgggtgctctaccacaatttcaccatatccaaagacaactgcctttccattgtttctgagattcaaccacagatgctggtggaattggcccctccatacttcctgagtaacttgcctcccagtgagagcagagaccttctgaaccagctaagggaaggaatggcagattctacagcagggagcaaatcatcctcagcccaggagttcagagatccctgtgtcctgcagtgacctgcctgcctatggaatggagctgggttcatctcatcacattagattatccctcagggtgacaccaaagcacccagacagatttagaagcccaaagtttagggtcaaatgtaaaccctggaacctgagtcccaagaaatggtagactgggaatggaaagaatggggtaaaccacagtctacatagggaaggactctttccttagccttctcttattgattggagagggactgacatgctcctcattctcttaactttgccaaacccattcttgtactcccttgtgatctataaaagatttttctatgatgccaa

SEQ ID NO: 150 - DNA, 2607 bp, Homo sapiens
ctgatggcgatgaatgaacactgcgtttgctgggaagatggtgtcggtcaccaaatatgaccttactggctgctctgccttctgcaggtcctgccagagagccaccatgacctctcagcctctcaggctagcagaagagtatggcccaagtcctggggagtctgaactggctgtgaacccctttgatgggcttcccttctcttcccgctactatgagctgctgaagcagcgccaagccttgcccatctgggctgctcgctttaccttcttggagcagttggagagtaaccccactggagtggtgctggtgtctggggagcctggttctggcaagagcacccagatccctcagtggtgtgcagagtttgcgctggccagagggttccagaaaggacaggttactgttactcagccctaccctcttgcagcccggagcctggctctgcgggttgctgatgagatggacctgaccctgggtcatgaggttggatacagcatcccccaggaggactgcacggggcccaacaccctgctcaggttctgctgggacaggctgcttctgcaggaggtggcctcgacccgaggcactggagcctggggcgtgctggtactagatgaggctcaggagcggtcggtggcatcagattcactccaggggctactgcaagatgccaggctggaaaaacttccgggggacctcagagtggttgtggttactgacccagcccttgaacctaagctccgagctttctggggcaatcctcctattgtgcatatacccagagagcctggtgagagaccttcccccatctactgggacaccatcccacctgatcgggtggaagctgcctgccaagcagtgcttgaattgtgtcggaaggagcttccaggagatgtgctagtgttcctgcccagtgaggaggaaatttccctgtgctgtgaatccttgtccagggaggtagagtccttgcttctccaagggcttccaccacgagtactgccccttcacccagactgtggacgagccgttcaggctgtgtatgaggacatggatgcccgaaaggttgtggtcactcactggctggctgacttctccttctccctcccttccatccaacatgtcatcgactcaggactggagctccgaagtgtttacaatcctaggatccgagcagaattccaagtgttgaggccaatcagcaagtgtcaggcagaggcaagacgattgcgagcaagagggttcccaccagtggtcttctttcccaggtctttttcccctcaggatcctgcctctgcctgtatcctaagtccttcttagaactagaagctccaccattgccacaacccagggtgtgtgaggagaatctgagctccctggtgttactactaaaaaggagacagattgcagagccaggggagtgtcacttcctggaccagcctgctccagaagcactgatgcaagccctggaagatttagactatctggcagccctggatgatgatggggacctgtcagatctgggtgtcatactatcagaattccctctggcccctgagctggccaaagccctgctggcctcatgcgagtttgactgtgtggacgagatgctcaccctggctgccatgctcacagctgcccctgggtttacccgtcctccactcagtgcagaagaagctgccctgcgtcgggccctggaacacacggatggtgaccacagttctctgatccaggtgtatgaagcctttatacaaagtggagcagatgaggcttggtgccaggctcgaggtctgaattgggcagcattgtgccaagcccataaacttcggggagaactcctagaactcatgcaacgaattgaacttcccttgtccctaccagcctttggctctgagcagaatcgcagagaccttcagaaagcactggtgtcaggatactttctcaaggtggccagagacacagacgggactggaaattaccttctcctaacccataagcatgtggcccagctctcctcatactgctgctaccgaagccgcagagctcctgccagacccccaccatgggtgctctaccacaatttcaccatatccaaagacaactgcctttccattgtttctgagattcaaccacagatgctggtggaattggcccctccatacttcctgagtaacttgcctcccagtgagagcagagaccttctgaaccagctaagggaaggaatggcagattctacagcagggagcaaatcatcctcagcccaggagttcagagatccctgtgtcctgcagtgacctgcctgcctatggaatggagctgggttcatctcatcacattagattatccctcagggtgacaccaaagcacccagacagatttagaagcccaaagtttagggtcaaatgtaaaccctggaacctgagtcccaagaaatggtagactgggaatggaaagaatggggtaaaccacagtctacatagggaaggactctttccttagccttctcttattgattggagagggactgacatgctcctcattctcttaactttgccaaacccattcttgtactcccttgtgatctataaaagatttttctatgatgccaa

SEQ ID NO: 151 - protein, 717 aa, Homo sapiens; identical to SEQ ID NO: 113

SEQ ID NO: 152 - protein, 767 aa, Homo sapiens
MNTAFAGKMVSVTKYDLTGCSAFCRSCQRATMTSQPLRLAEEYGPSPGESELAVNPFDGLPFSSRYYELLKQRQALPIWAARFTFLEQLESNPTGVVLVSGEPGSGKSTQIPQWCAEFALARGFQKGQVTVTQPYPLAARSLALRVADEMDLTLGHEVGYSIPQEDCTGPNTLLRFCWDRLLLQEVASTRGTGAWGVLVLDEAQERSVASDSLQGLLQDARLEKLPGDLRVVVVTDPALEPKLRAFWGNPPIVHIPREPGERPSPIYWDTIPPDRVEAACQAVLELCRKELPGDVLVFLPSEEVKKQNKTKKTACKMSLQKEEISLCCESLSREVESLLLQGLPPRVLPLHPDCGRAVQAVYEDMDARKVVVTHWLADFSFSLPSIQHVIDSGLELRSVYNPRIRAEFQVLRPISKCQAEARRLRARGFPPGSCLCLYPKSFLELEAPPLPQPRVCEENLSSLVLLLKRRQIAEPGECHFLDQPAPEALMQALEDLDYLAALDDDGDLSDLGVILSEFPLAPELAKALLASCEFDCVDEMLTLAAMLTAAPGFTRPPLSAEEAALRRALEHTDGDHSSLIQVYEAFIQSGADEAWCQARGLNWAALCQAHKLRGELLELMQRIELPLSLPAFGSEQNRRDLQKALVSGYFLKVARDTDGTGNYLLLTHKHVAQLSSYCCYRSRRAPARPPPWVLYHNFTISKDNCLSIVSEIQPQMLVELAPPYFLSNLPPSESRDLLNQLREGMADSTAGSKSSSAQEFRDPCVLQ

SEQ ID NO: 153 - protein, 385 aa, Homo sapiens
MNTAFAGKMVSVTKYDLTGCSAFCRSCQRATMTSQPLRLAEEYGPSPGESELAVNPFDGLPFSSRYYELLKQRQALPIWAARFTFLEQLESNPTGVVLVSGEPGSGKSTQIPQWCAEFALARGFQKGQVTVTQPYPLAARSLALRVADEMDLTLGHEVGYSIPQEDCTGPNTLLRFCWDRLLLQEVASTRGTGAWGVLVLDEAQERSVASDSLQGLLQDARLEKLPGDLRVVVVTDPALEPKLRAFWGNPPIVHIPREPGERPSPIYWDTIPPDRVEAACQAVLELCRKELPGDVLVFLPSEEEISLCCESLSREVESLLLQGLPPRVLPLHPDCGRAVQAVYEDMDARKVVVTHWLADFSFSLPSIQHVIDSGLELRSVSERER

SEQ ID NO: 154 - protein, 385 aa, Homo sapiens
MAHSDLSWPWLGDGQQVYNPRIRAEFQVLRPISKCQAEARRLRARGFPPGSCLCLYPKSFLELEAPPLPQPRVCEENLSSLVLLLKRRQIAEPGECHFLDQPAPEALMQALEDLDYLAALDDDGDLSDLGVILSEFPLAPELAKALLASCEFDCVDEMLTLAAMLTAAPGFTRPPLSAEEAALRRALEHTDGDHSSLIQVYEAFIQSGADEAWCQARGLNWAALCQAHKLRGELLELMQRIELPLSLPAFGSEQNRRDLQKALVSGYFLKVARDTDGTGNYLLLTHKHVAQLSSYCCYRSRRAPARPPPWVLYHNFTISKDNCLSIVSEIQPQMLVELAPPYFLSNLPPSESRDLLNQLREGMADSTAGSKSSSAQEFRDPCVLQ

SEQ ID NO: 155 - protein, 434 aa, Homo sapiens
MNTAFAGKMVSVTKYDLTGCSAFCRSCQRATMTSQPLRLAEEYGPSPGESELAVNPFDGLPFSSRYYELLKQRQALPIWAARFTFLEQLESNPTGVVLVSGEPGSGKSTQIPQWCAEFALARGFQKGQVTVTQPYPLAARSLALRVADEMDLTLGHEVGYSIPQEDCTGPNTLLRFCWDRLLLQEVASTRGTGAWGVLVLDEAQERSVASDSLQGLLQDARLEKLPGDLRVVVVTDPALEPKLRAFWGNPPIVHIPREPGERPSPIYWDTIPPDRVEAACQAVLELCRKELPGDVLVFLPSEEEISLCCESLSREVESLLLQGLPPRVLPLHPDCGRAVQAVYEDMDARKVVVTHWLADFSFSLPSIQHVIDSGLELRSVYNPRIRAEFQVLRPISKCQAEARRLRARGFPPVVFFPRSFSPQDPASACILSPS

SEQ ID NO: 156 - protein, 278 aa, Homo sapiens
MQALEDLDYLAALDDDGDLSDLGVILSEFPLAPELAKALLASCEFDCVDEMLTLAAMLTAAPGFTRPPLSAEEAALRRALEHTDGDHSSLIQVYEAFIQSGADEAWCQARGLNWAALCQAHKLRGELLELMQRIELPLSLPAFGSEQNRRDLQKALVSGYFLKVARDTDGTGNYLLLTHKHVAQLSSYCCYRSRRAPARPPPWVLYHNFTISKDNCLSIVSEIQPQMLVELAPPYFLSNLPPSESRDLLNQLREGMADSTAGSKSSSAQEFRDPCVLQ

SEQ ID NO: 157 - DNA, 4977 bp, Homo sapiens
cacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacacgcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagcgggaagggcctgttggcggggagagtgactcggaggagatgtttgagaagacgtcgggcttcgggagcgggaagccatcggaggccagcgagccatgccccacggagctcctgaaggcccgggaggactctgagtacctagtgaccctaaaacacgaggcccagcggctagagcggacggtggagcgcctcatcacggacaccgacagcttcctccatgatgcggggctgcggggtggtgcgcccttaccggggcctggcctccagggcgaagaggagcagggtgagggggaccagcaggagccccagctgctggggaccatcaacgccaagatgaaggctttcaagaaagagctgcaggccttcctgcagcaggtgaaccgcattggggatggcctatcccccttgccccacctcacagagtcctctagcttcctctccactgtgacttccgtgtcccgggactcccccatcgggaacctggggaaggagctgggcccagacttgcagtccagactgaaagagcagctggagtggcagctcgggccggcccaaggggacgagcgggagagcctgcgcctccgagccgcgcgggagctgcaccgccgcgcagacggggacaccgggagccacgggctgggaggccagacctgcttcagcctggagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcagttgcagaaagagaacagtccccggagaggtggcagtttcctctgtgatcaaaaagacggcaacgttcgcccctttccccaccagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggaagaagaaaatcacaaaggaaatcttcaaagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaaggggggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttcccggagccttaggagcagacaggtggcccctgccatcgagaaggtgcaggccaagtttgaacgcacatgctgctcccccaagtatggttctcccaagctgcagaggaagcccctccccaaagccgaccagccaaataacaggccaggaaacaggcaccaattcccgaggaaggtcgcctagccccattggggtggggtcagagatgtgcagggaggaagggggagagggcacgccagtgaagcaggacttatctgctccccctggctacaccctcactgagaacgtggcccggatcctcaacaagaagctgctggaacatgccttaaaggaggagaggaggcaggctgcccacgggcccccgggtctccacagtgacagccactcgctgggggacacagccgagccagggcccatggaggaactaccttgttctgcactagctccatccctagagccctgcttctccaggcccgagagaccagcaaaccgtcgccctccgtcccgttgggccccacattcccccactgcctcacagcctcagtcacccggagacccgacgtccttggaggagcatggtggcgaggagccgcccgaggagcagccacaccgagatgcaagcttgcatggattatcacagtataattcactgtaatttgcataaccacaccatcaccatgaacaaaactctgcccaacaggagagatctagttttctcaaggtcaaagaatgttttttaaaaacacaaagctgctgaatgttcaacctgtgaaactgagatgtttctagaatgaaacagtaaatgtgcctgtaataacttaatttttttcatagctcagaaaactatttttgtctccatcttttttacacacagtatattaaacgaaaaggtaaataaggtataaatagatttaaaaaataaaagttttaaaaaatgtacattttaagagattctgaacaccctcgctgtcaatacctgactgcctctgttaaatttgcactgttacattttggttcagtttatttccatgttgaattagagtggattaagttaattttattttgtcagtgttactgttttttacgaattttttaatgcttcagactgtctgattcagtgaactttttgtagtgaaaaagccatgaagccagtagacaagacagatattctgtatgctggaggggatacaggatgattttgaaaaggtacaaagtcctcagtgggcttagaaaattcactgtatgatccttatattatcctacttggcttgcacgtcttcgggtgcatgtatataccgctactgtgtcctcgccatcacctaaatgtgactcagtctgttccactgtaatatgttgtgaatttccttgtactgtacttttattgttggtcttcttgcatcgatgatccaacagcaacaccatttttaaattattgtgaaaagattaactggcaatgtacagagtttactcaaagttttcttaagggaaaacactacaaaaagtcacaaggataccaaatggaaacacatgatgatgcctctgggtctgtatgagaccgtgatgaagtagaaataaagcccttctgagatggc

SEQ ID NO: 158 - DNA, 5225 bp, Homo sapiens
cacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacacgcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagtgggaagggcctgttggcggggagagtgactcggaggagatgtttgagaagacgtcgggcttcgggagcgggaagccatcggaggccagcgagccatgccccacggagctcctgaaggcccgggaggactctgagtacctagtgaccctaaaacacgaggcccagcggctagagcggacggtggagcgcctcatcacggacaccgacagcttcctccatgatgcggggctgcggggtggtgcgcccttaccggggcctggcctccagggcgaagaggagcagggtgagggggaccagcaggagccccagctgctggggaccatcaacgccaagatgaaggctttcaagaaagagctgcaggccttcctggagcaggtgaaccgcattggggatggcctatcccccttgccccacctcacagagtcctctagcttcctctccactgtgacttccgtgtcccgggactcccccatcgggaacctggggaaggagctgggcccagacttgcagtccagactgaaagagcagctggagtggcagctcgggccggcccgaggggacgagcgggagagcctgcgcctccgagccgcgcgggagctgcaccgccgcgcagacggggacaccgggagccacgggctgggaggccagacctgcttcagcctggagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagaattgttgtggatatcccagaattaacattgaggaggagactttaggcttcaccaggctgccagctgggtccacggtaaaaacgttgaagagccttgggttgcagagattggagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggaagaagaaaatcacaaaggaaatcttcaaagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaaggggggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttcccggagccttaggagcagacaggtggcccctgccatcgagaaggtgcaggccaagtttgaacgcacatgctgctcccccaagtatggttctcccaagctgcagaggaagcccctccccaaagccgaccagccaaataacaggacgtcaccagggatggcccagaaagggtacagtgagtcagcctgggcccgctccaccaccacaagggagagccccgtgcacaccaccattaatgatggcctctccagcctcttcaacatcattgaccacagccccgtggtgcaggaccccttccagaaggggctgcgggccggcagtcggtctcgctcagcagagccccgaccagagctgggcccaggccaggaaacaggcaccaattcccgaggaaggtcgcctagccccattggggtggggtcagagatgtgcagggaggaagggggagagggcacgccagtgaagcaggacttatctgctccccctggctacaccctcactgagaacgtggcccggatcctcaacaagaagctgctggaacatgccttaaaggaggagaggaggcaggctgcccacgggcccccgggtctccacagtgacagccactcgctgggggacacagccgagccagggcccatggaggaactaccttgttctgcactagctccatccctagagccctgcttctccaggcccgagagaccagcaaaccgtcgccctccgtcccgttgggccccacattcccccactgcctcacagcctcagtcacccggagacccgacgtccttggaggagcatggtggcgaggagccgcccgaggagcagccacaccgagatgcaagcttgcatggattatcacagtataattcactgtaatttgcataaccacaccatcaccatgaacaaaactctgcccaacaggagagatctagttttctcaaggtcaaagaatgttttttaaaaacacaaagctgctgaatgttcaacctgtgaaactgagatgtttctagaatgaaacagtaaatgtgcctgtaataacttaatttttttcatagctcagaaaactatttttgtctccatcttttttacacacagtatattaaacgaaaaggtaaataaggtataaatagatttaaaaaataaaagttttaaaaaatgtacattttaagagattctgaacaccctcgctgtcaatacctgactgcctctgttaaatttgcactgttacattttggttcagtttatttccatgttgaattagagtggattaagttaattttattttgtcagtgttactgttttttacgaattttttaatgcttcagactgtctgattcagtgaactttttgtagtgaaaaagccatgaagccagtagacaagacagatattctgtatgctggaggggatacaggatgattttgaaaaggtacaaagtcctcagtgggcttagaaaattcactgtatgatccttatattatcctacttggcttgcacgtcttcgggtgcatgtatataccgctactgtgtcctcgccatcacctaaatgtgactcagtctgttccactgtaatatgttgtgaatttccttgtactgtacttttattgttggtcttcttgcatcgatgatccaacagcaacaccatttttaaattattgtgaaaagattaactggcaatgtacagagtttactcaaagttttcttaagggaaaacactacaaaaagtcacaaggataccaaatggaaacacatgatgatgcctctgggtctgtatgagaccgtgatgaagtagaaataaagcccttctgagatggc

SEQ ID NO: 159 - protein, 1142 aa, Homo sapiens; identical to SEQ ID NO: 50

SEQ ID NO: 160 - protein, 1382 aa, Homo sapiens
MEDTRGQQEREGPGRDHAPSIPTSPFGDSLESSTELRRHLQFVEEEAELLRRSISEIEDHNRQLTHELSKFKFEPPREPGWLGEGASPGAGGGAPLQEELKSARLQISELSGKVLKLQHENHALLSNIQRCDLAAHLGLRAPSPRDSDAESDAGKKESDGEESRLPQPKWEGPVGGESDSEEMFEKTSGFGSGKPSEASEPCPTELLKAREDSEYLVTLKHEAQRLERTVERLITDTDSFLHDAGLRGGAPLPGPGLQGEEEQGEGDQQEPQLLGTINAKMKAFKKELQAFLEQVNRIGDGLSPLPHLTESSSFLSTVTSVSRDSPIGNLGKELGPDLQSRLKEQLEWQLGPARGDERESLRLRAARELHRRADGDTGSHGLGGQTCFSLEMEEEHLYALRWKELEMHSLALQNTLHERTWSDEKNLMQQELRSLKQNIFLFYVKLRWLLKHWRQGKQMEEEGEEFTEGEHPETLSRLGELGVQGGHQADGPDHDSDRGCGFPVGEHSPHSRVQIGDHSLRLQTADRGQPHKQVVENQQLFSAFKALLEDFRAELREDERARLRLQQQYASDKAAWDVEWAVLKCRLEQNCCGYPRINIEEETLGFTRLPAGSTVKTLKSLGLQRLELEEKTENKLGELGSSAESKGALKKEREVHQKLLADSHSLVMDLRWQIHHSEKNWNREKVELLDRLDRDRQEWERQKKEFLWRIEQGSLRMPRPVAMWPCADADSIPFEDRPLSKLKESDRCSASENLYLDALSLDDEPEEPPAHRPEREFRNRLPEEEENHKGNLQRAVSVSSMSEFQRLMDISPFLPEKGLPSTSSKEDVTPPLSPDDLKYIEEFNKSWDYTPNRGHNGGGPDLWADRTEVGRAGHEDSTEPFPDSSWYLTTSVTMTTDTMTSPEHCQKQPLRSHVLTEQSGLRVLHSPPAVRRVDSITAAGGEGPFPTSRARGSPGDTKGGPPEPMLSRWPCTSPRHSRDYVEGARRPLDSPLCTSLGFASPLHSLEMSKNLSDDMKEVAFSVRNAICSGPGELQVKDMACQTNGSRTMGTQTVQTISVGLQTEALRGSGVTSSPHKCLTPKAGGGATPVSSPSRSLRSRQVAPAIEKVQAKFERTCCSPKYGSPKLQRKPLPKADQPNNRTSPGMAQKGYSESAWARSTTTRESPVHTTINDGLSSLFNIIDHSPVVQDPFQKGLRAGSRSRSAEPRPELGPGQETGTNSRGRSPSPIGVGSEMCREEGGEGTPVKQDLSAPPGYTLTENVARILNKKLLEHALKEERRQAAHGPPGLHSDSHSLGDTAEPGPMEELPCSALAPSLEPCFSRPERPANRRPPSRWAPHSPTASQPQSPGDPTSLEEHGGEEPPEEQPHRDASLHGLSQYNSL

SEQ ID NO: 161 - DNA, 2222 bp, Homo sapiens
acaactgtctgctgcgcccgaaaaacaagtcggtgcgctggggacccggggccggggccgccttactccggcctagccccgcggccctcggtgcgggctccagggcatgctcggtaccccccgcggctccagcccagacgccccggcctcagaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatt

SEQ ID NO: 162 - DNA, 2067 bp, Homo sapiens
acaactgtctgctgcgcccgaaaaacaagtcggtgcgctggggacccggggccggggccgccttactccggcctagccccgcggccctcggtgcgggctccagggcatgctcggtaccccccgcggctccagcccagacgccccggcctcaggtctcggcccccgcttggggccccggccgtgcggcgcgagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatt

SEQ ID NO: 163 - DNA, 2318 bp, Homo sapiens
acaactgtctgctgcgcccgaaaaacaagtcggtgcgctggggacccggggccggggccgccttactccggcctagccccgcggccctcggtgcgggctccagggcatgctcggtaccccccgcggctccagcccagacgccccggcctcaggtctcggcccccgcttggggccccggccgtgcggcgcgagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatt

SEQ ID NO: 164 - DNA, 2523 bp, Homo sapiens
acaactgtctgctgcgcccgaaaaacaagtcggtgcgctggggacccggggccggggccgccttactccggcctagccccgcggccctcggtgcgggctccagggcatgctcggtaccccccgcggctccagcccagacgccccggcctcaggtctcggcccccgcttggggccccggccgtgcggcgcgagggagcggccggatggagcggaggatgaaagccggatacttggaccagcaagtgccctacaccttcagcagcgtgagcgccgcgccggcctccacgcccgccccgccccgcacccagcccctactctcaccacagcccccctccccgcagtcccagcggagtcctgggctgccccgcccctgagtcacccgaggaccccaacctcgtcccccagactaagcgcctcagggtgactcgcgggcattctccccgcttctcgcagaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatt

SEQ ID NO: 165 - protein, 514 aa, Homo sapiens
NCLLRPKNKSVRWGPGAGAALLRPSPAALGAGSRACSVPPAAPAQTPRPQKSPGNGSLREALIGPLGKLMDPGSLPPLDSEDLFQDLSHFQETWLAEAQVPDSDEQFVPDFHSENLAFHSPTTRIKKEPQSPRTDPALSCSRKPPLPYHHGEQCLYSSAYDPPRQIAIKSPAPGALGQSPLQPFPRAEQRNFLRSSGTSQPHPGHGYLGEHSSVFQQPLDICHSFTSQGGGREPLPAPYQHQLSEPCPPYPQQSFKQEYHDPLYEQAGQPAVDQGGVNGHRYPGAGVVIKQEQTDFAYDSDVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 166 - protein, 269 aa, Homo sapiens
NCLLRPKNKSVRWGPGAGAALLRPSPAALGAGSRACSVPPAAPAQTPRPQVSAPAWGPGRAARGSGRMERRMKAGYLDQQVPYTFSSKSPGNGSLREALIGPLGKLMDPGSLPPLDSEDLFQDLSHFQETWLAEAQVPDSDEQFVPDFHSENLAFHSPTTRIKKEPQSPRTDPALSCSRKPPLPYHHGEQCLYSSAYDPPRQIAIKSPAPGALGQSPLQPFPRAEQRNFLRSSGTSQPHPGHGYLGEHRCHRVRINVPPHRGLLWALSR

SEQ ID NO: 167 - protein, 221 aa, Homo sapiens
MGTSGNIDVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 168 - protein, 546 aa, Homo sapiens
NCLLRPKNKSVRWGPGAGAALLRPSPAALGAGSRACSVPPAAPAQTPRPQVSAPAWGPGRAARGSGRMERRMKAGYLDQQVPYTFSSKSPGNGSLREALIGPLGKLMDPGSLPPLDSEDLFQDLSHFQETWLAEAQVPDSDEQFVPDFHSENLAFHSPTTRIKKEPQSPRTDPALSCSRKPPLPYHHGEQCLYSSAYDPPRQIAIKSPAPGALGQSPLQPFPRAEQRNFLRSSGTSQPHPGHGYLGEHSSVFQQPLDICHSFTSQGGGREPLPAPYQHQLSEPCPPYPQQSFKQEYHDPLYEQAGQPAVDQGGVNGHRYPGAGVVIKQEQTDFAYDSDVTGCASMYLHTEGFSGPSPGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 169 - protein, 445 aa, Homo sapiens
MDPGSLPPLDSEDLFQDLSHFQETWLAEAQVPDSDEQFVPDFHSENLAFHSPTTRIKKEPQSPRTDPALSCSRKPPLPYHHGEQCLYSSAYDPPRQIAIKSPAPGALGQSPLQPFPRAEQRNFLRSSGTSQPHPGHGYLGEHSSVFQQPLDICHSFTSQGGGREPLPAPYQHQLSEPCPPYPQQSFKQEYHDPLYEQAGQPAVDQGGVNGHRYPGAGVVIKQEQTDFAYDSDVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 170 - DNA, 2364 bp, Homo sapiens
ccacgcgtccggcgcgggcgcgggcgcgggcgcgtgcgggctgcgagccgggaggcggcggcggcgacggcgacggcggcggcatggcggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccggaactgacctctccccgcctcatcaagagccacctgccctaccgctttctgccctctgacctccacaatggagactccaaggtcatctatatggctcgcaaccccaaggatctggtggtgtcttattatcagttccaccgctctctgcggaccatgagctaccgaggcacctttcaagaattctgccggaggtttatgaatgataagctgggctacggctcctggtttgagcacgtgcaggagttctgggagcaccgcatggactcgaacgtgctttttctcaagtatgaagacatgcatcgggacctggtgacgatggtggagcagctggccagattcctgggggtgtcctgtgacaaggcccagctggaagccctgacggagcactgccaccagctggtggaccagtgctgcaacgctgaggccctgcccgtgggccggggaagagttgggctgtggaaggacatcttcaccgtctccatgaatgagaagtttgacttggtgtataaacagaagatgggaaagtgtgacctcacgtttgacttttatttataataacagaaacaacaacctgcatgctcacaatacccagacagtctactagccaaaagtcctgtatgcattcatttattccttgctggacaaactctggaagcagcgtgtgaaacagcgggggaagggaagagcggcgtgagcggagggagtgtgatgattcccaaccgaaagcagctgtctcgcctttagaacgtgcagcctctccatgtctgattacaaacagtctccacattgcagttccaatggcctggaccgtaaggataaagcctgtaatatatgcaactagaatgtctgccttttcaaccccgtattatttattgtattttatagagcttttcactggaaatctacataaatgtcagtaaaccaaataaaagttcatttccaaggggaatcaggagcgagccacacccgaatggtagaaagatctcagggttaactctttatttttgtagttttattatctaaggcacagccattctgttctcacttggttctgagatagtggtgagaacagaggatgagttgggtctgttggggggaatctggacacttgtttattctgacggagttcacttcttcagaaccttcctgaaatgagcagaaattgttcactaggtcttcagaatggacgtccttctgccagagacttccagcgggcggctccaaaggcccaatgcagaggagcccgcggagcatgtgctgagggaagtctgcctggtgaggctggcaggtgggagtctaatgcagtcaggagcatttgcatgcagtgggtggagagtcggccaccaaaggaccgagttgcgctcggaatttgagctgaattccacagccttactttgtttcctgaagtgatagcctactaatgctggcaagcagatgcttaatagtaaatttctaaaatccccgggtctttatcattcagtttgttctgtgcacctgaggcgctcagccgtgggaggaccattttgcgagtgtagccctgtttcactcggatcaggttggcacggccgcctgcgtgtctgtccacctcatccctccgtgtatctgagggagtaaaggtgaggtctttattgcttcactgcctaattttctcacccacattcgctgaagcgatggagagtcgggggccagtagccagccaaccccgtggggaccggggttgtctgtcatttatgtggctggaaagcacccaaagtggtggtcaggagggtcgctgctgtggaaggggtctccgttcttggtgctgtatttgaaacgggtgtagagagaagcttgtgtttttgtttgtaatggggagaagcgtggccaggcagtggcacgtggcatcgcatggtgggctcggcagcaccttgcctgtgtttctgtgagggaggctgctttctgtgaaatttctttatatttttctatttttagtactgtatggatgttactgagcactacacatgatccttctgtgcttgcttgcatctttaataaagacatgttcccggcaaaaaaaaaaaaaaaaaaaaaaaaaaaaaaaaaaaaaaaaaaaaaaaaaaaaaaaaaaaaaaa

SEQ ID NO: 171 - DNA, 2156 bp, Homo sapiens
ccacgcgtccggcgcgggcgcgggcgcgggcgcgtgcgggctgcgagccgggaggcggcggcggcgacggcgacggcggcggcatggcggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccgtgggctacggctcctggtttgagcacgtgcaggagttctgggagcaccgcatggactcgaacgtgctttttctcaagtatgaagacatgcatcgggacctggtgacgatggtggagcagctggccagattcctgggggtgtcctgtgacaaggcccagctggaagccctgacggagcactgccaccagctggtggaccagtgctgcaacgctgaggccctgcccgtgggccggggaagagttgggctgtggaaggacatcttcaccgtctccatgaatgagaagtttgacttggtgtataaacagaagatgggaaagtgtgacctcacgtttgacttttatttataataacagaaacaacaacctgcatgctcacaatacccagacagtctactagccaaaagtcctgtatgcattcatttattccttgctggacaaactctggaagcagcgtgtgaaacagcgggggaagggaagagcggcgtgagcggagggagtgtgatgattcccaaccgaaagcagctgtctcgcctttagaacgtgcagcctctccatgtctgattacaaacagtctccacattgcagttccaatggcctggaccgtaaggataaagcctgtaatatatgcaactagaatgtctgccttttcaaccccgtattatttattgtattttatagagcttttcactggaaatctacataaatgtcagtaaaccaaataaaagttcatttccaaggggaatcaggagcgagccacacccgaatggtagaaagatctcagggttaactctttatttttgtagttttattatctaaggcacagccattctgttctcacttggttctgagatagtggtgagaacagaggatgagttgggtctgttggggggaatctggacacttgtttattctgacggagttcacttcttcagaaccttcctgaaatgagcagaaattgttcactaggtcttcagaatggacgtccttctgccagagacttccagcgggcggctccaaaggcccaatgcagaggagcccgcggagcatgtgctgagggaagtctgcctggtgaggctggcaggtgggagtctaatgcagtcaggagcatttgcatgcagtgggtggagagtcggccaccaaaggaccgagttgcgctcggaatttgagctgaattccacagccttactttgtttcctgaagtgatagcctactaatgctggcaagcagatgcttaatagtaaatttctaaaatccccgggtctttatcattcagtttgttctgtgcacctgaggcgctcagccgtgggaggaccattttgcgagtgtagccctgtttcactcggatcaggttggcacggccgcctgcgtgtctgtccacctcatccctccgtgtatctgagggagtaaaggtgaggtctttattgcttcactgcctaattttctcacccacattcgctgaagcgatggagagtcgggggccagtagccagccaaccccgtggggaccggggttgtctgtcatttatgtggctggaaagcacccaaagtggtggtcaggagggtcgctgctgtggaaggggtctccgttcttggtgctgtatttgaaacgggtgtagagagaagcttgtgtttttgtttgtaatggggagaagcgtggccaggcagtggcacgtggcatcgcatggtgggctcggcagcaccttgcctgtgtttctgtgagggaggctgctttctgtgaaatttctttatatttttctatttttagtactgtatggatgttactgagcactacacatgatccttctgtgcttgcttgcatctttaataaagacatgttcccggcaaaaaaaaaaaaaaaaaaaaaaaaaaaaaaaaaaaaaaaaaaaaaaaaaaaaaaaaaaaaaaa

SEQ ID NO: 172 - protein, 218 aa, Homo sapiens
MACGCRPSAAGRWRRSPTSRCGPATCGSSPTPSPELTSPRLIKSHLPYRFLPSDLHNGDSKVIYMARNPKDLVVSYYQFHRSLRTMSYRGTFQEFCRRFMNDKLGYGSWFEHVQEFWEHRMDSNVLFLKYEDMHRDLVTMVEQLARFLGVSCDKAQLEALTEHCHQLVDQCCNAEALPVGRGRVGLWKDIFTVSMNEKFDLVYKQKMGKCDLTFDFYL

SEQ ID NO: 173 - protein, 171 aa, Homo sapiens
MAESEAETPSTPGEFESKYFEFHGVRLPPFCRGKMEEIANFPVRPSDVWIVTYPKSVGYGSWFEHVQEFWEHRMDSNVLFLKYEDMHRDLVTMVEQLARFLGVSCDKAQLEALTEHCHQLVDQCCNAEALPVGRGRVGLWKDIFTVSMNEKFDLVYKQKMGKCDLTFDFYL

SEQ ID NO: 174 - protein, 14 aa, Tetanus toxoid
QYIKANSKFIGITE

SEQ ID NO: 175 - protein, 21 aa, Plasmodium falciparum
DIEKKIAKMEKASSVFNVVNS

SEQ ID NO: 176 - protein, 16 aa, Streptococcus
GAVDSILGGVATYGAA

SEQ ID NO: 177 - protein, 13 aa, Artificial Sequence
  PAN-DR-binding epitope
  VARIANT 1, 13: Xaa = D-alanine
  VARIANT 1, 13: Xaa = L-alanine
  VARIANT 3: Xaa = cyclohexylalanine
  VARIANT 3: Xaa = phenylalanine
  VARIANT 3: Xaa = tyrosine
XKXVAAWTLKAAX

SEQ ID NO: 178 - DNA, 14 bp, Artificial Sequence
  cDNA synthesis primer
ttttgatcaagctt

SEQ ID NO: 179 - DNA, 42 bp, Artificial Sequence
  Primer
ctaatacgactcactatagggctcgagcggccgcccgggcag

SEQ ID NO: 180 - DNA, 12 bp, Artificial Sequence
  Primer
gatcctgcccgg

SEQ ID NO: 181 - DNA, 40 bp, Artificial Sequence
  Primer
gtaatacgactcactatagggcagcgtggtcgcggccgag

SEQ ID NO: 182 - DNA, 10 bp, Artificial Sequence
  Primer
gatcctcggc

SEQ ID NO: 183 - DNA, 22 bp, Artificial Sequence
  PCR Primer
ctaatacgactcactatagggc

SEQ ID NO: 184 - DNA, 22 bp, Artificial Sequence
  Nested Primer
tcgagcggccgcccgggcagga

SEQ ID NO: 185 - DNA, 20 bp, Artificial Sequence
  Nested Primer
agcgtggtcgcggccgagga

SEQ ID NO: 186 - DNA, 25 bp, Artificial Sequence
  Primer
atatcgccgcgctcgtcgtcgacaa

SEQ ID NO: 187 - DNA, 26 bp, Artificial Sequence
  Primer
agccacacgcagctcattgtagaagg

SEQ ID NO: 188 - DNA, 24 bp, Artificial Sequence
  Epitope Tag
gattacaaggatgacgacgataag

SEQ ID NO: 189 - protein, 15 aa, Homo sapiens
FQSENEAYPPAERIS

SEQ ID NO: 190 - protein, 4 aa, Homo sapiens
SENE

SEQ ID NO: 191 - protein, 4 aa, Homo sapiens
SAEE

SEQ ID NO: 192 - protein, 4 aa, Homo sapiens
SEED

SEQ ID NO: 193 - protein, 4 aa, Homo sapiens
SFEE

SEQ ID NO: 194 - protein, 6 aa, Homo sapiens
GQSKSK

SEQ ID NO: 195 - protein, 6 aa, Homo sapiens
GIKAST

SEQ ID NO: 196 - protein, 6 aa, Homo sapiens
GGDAAE

SEQ ID NO: 197 - protein, 6 aa, Homo sapiens
GGEDSE

SEQ ID NO: 198 - protein, 6 aa, Homo sapiens
GIIRSG

SEQ ID NO: 199 - protein, 4 aa, Homo sapiens
TPCD

SEQ ID NO: 200 - protein, 6 aa, Homo sapiens
GAHQAV

SEQ ID NO: 201 - protein, 6 aa, Homo sapiens
GGQWGT

SEQ ID NO: 202 - protein, 6 aa, Homo sapiens
GQWGTV

SEQ ID NO: 203 - protein, 6 aa, Homo sapiens
GTVNNH

SEQ ID NO: 204 - protein, 4 aa, Homo sapiens
NETF

SEQ ID NO: 205 - protein, 4 aa, Homo sapiens
NISA

SEQ ID NO: 206 - protein, 4 aa, Homo sapiens
NFSI

SEQ ID NO: 207 - protein, 4 aa, Homo sapiens
NKTS

SEQ ID NO: 208 - protein, 4 aa, Homo sapiens
NKSK

SEQ ID NO: 209 - protein, 4 aa, Homo sapiens
NYTG

SEQ ID NO: 210 - protein, 15 aa, Homo sapiens
EEEEEAFYEDLDDIL

SEQ ID NO: 211 - protein, 4 aa, Homo sapiens
RRNS

SEQ ID NO: 212 - protein, 4 aa, Homo sapiens
KKLS

SEQ ID NO: 213 - protein, 4 aa, Homo sapiens
TLRE

SEQ ID NO: 214 - protein, 4 aa, Homo sapiens
TKKE

SEQ ID NO: 215 - protein, 4 aa, Homo sapiens
SGEE

SEQ ID NO: 216 - protein, 4 aa, Homo sapiens
TAEE

SEQ ID NO: 217 - protein, 4 aa, Homo sapiens
SVLE

SEQ ID NO: 218 - protein, 4 aa, Homo sapiens
SALD

SEQ ID NO: 219 - protein, 4 aa, Homo sapiens
SGDE

SEQ ID NO: 220 - protein, 4 aa, Homo sapiens
SFKD

SEQ ID NO: 221 - protein, 4 aa, Homo sapiens
SMRD

SEQ ID NO: 222 - protein, 4 aa, Homo sapiens
TQGD

SEQ ID NO: 223 - protein, 4 aa, Homo sapiens
SLQE

SEQ ID NO: 224 - protein, 4 aa, Homo sapiens
SELE

SEQ ID NO: 225 - protein, 4 aa, Homo sapiens
SHQE

SEQ ID NO: 226 - protein, 4 aa, Homo sapiens
SSNE

SEQ ID NO: 227 - protein, 4 aa, Homo sapiens
SGPD

SEQ ID NO: 228 - protein, 4 aa, Homo sapiens
TSVE

SEQ ID NO: 229 - protein, 4 aa, Homo sapiens
SVEE

SEQ ID NO: 230 - protein, 4 aa, Homo sapiens
TDKE

SEQ ID NO: 231 - protein, 4 aa, Homo sapiens
SSQE

SEQ ID NO: 232 - protein, 4 aa, Homo sapiens
SQEE

SEQ ID NO: 233 - protein, 4 aa, Homo sapiens
SRED

SEQ ID NO: 234 - protein, 4 aa, Homo sapiens
SQAE

SEQ ID NO: 235 - protein, 4 aa, Homo sapiens
TLSE

SEQ ID NO: 236 - protein, 4 aa, Homo sapiens
SCVD

SEQ ID NO: 237 - protein, 4 aa, Homo sapiens
TSRD

SEQ ID NO: 238 - protein, 4 aa, Homo sapiens
TASE

SEQ ID NO: 239 - protein, 8 aa, Homo sapiens
KVTEAFDY

SEQ ID NO: 240 - protein, 9 aa, Homo sapiens
RSSNEFMRY

SEQ ID NO: 241 - protein, 6 aa, Homo sapiens
GSPCSE

SEQ ID NO: 242 - protein, 6 aa, Homo sapiens
GSLVNG

SEQ ID NO: 243 - protein, 6 aa, Homo sapiens
GVLSGE

SEQ ID NO: 244 - protein, 6 aa, Homo sapiens
GSRKSV

SEQ ID NO: 245 - protein, 6 aa, Homo sapiens
GSLSSS

SEQ ID NO: 246 - protein, 6 aa, Homo sapiens
GIKNNI

SEQ ID NO: 247 - protein, 6 aa, Homo sapiens
GTLLTF

SEQ ID NO: 248 - protein, 6 aa, Homo sapiens
GIPKNM

SEQ ID NO: 249 - protein, 4 aa, Homo sapiens
SGKK

SEQ ID NO: 250 - protein, 17 aa, Homo sapiens
KKLSDILNEKAGKAKTK

SEQ ID NO: 251 - protein, 8 aa, Homo sapiens
GSLVNGKS

SEQ ID NO: 252 - protein, 8 aa, Homo sapiens
GKKEKGKS

SEQ ID NO: 253 - protein, 22 aa, Homo sapiens
LPIILTALATKKENLAYGKGVL

SEQ ID NO: 254 - protein, 4 aa, Homo sapiens
NYTI

SEQ ID NO: 255 - protein, 4 aa, Homo sapiens
NLSL

SEQ ID NO: 256 - protein, 4 aa, Homo sapiens
NKSL

SEQ ID NO: 257 - protein, 4 aa, Homo sapiens
NISI

SEQ ID NO: 258 - protein, 4 aa, Homo sapiens
NATT

SEQ ID NO: 259 - protein, 4 aa, Homo sapiens
NVTD

SEQ ID NO: 260 - protein, 4 aa, Homo sapiens
NDTV

SEQ ID NO: 261 - protein, 4 aa, Homo sapiens
NQSA

SEQ ID NO: 262 - protein, 4 aa, Homo sapiens
NVTV

SEQ ID NO: 263 - protein, 4 aa, Homo sapiens
NISF

SEQ ID NO: 264 - protein, 4 aa, Homo sapiens
NCSY

SEQ ID NO: 265 - protein, 4 aa, Homo sapiens
NDTG

SEQ ID NO: 266 - protein, 4 aa, Homo sapiens
NITL

SEQ ID NO: 267 - protein, 4 aa, Homo sapiens
NESV

SEQ ID NO: 268 - protein, 4 aa, Homo sapiens
NATL

SEQ ID NO: 269 - protein, 4 aa, Homo sapiens
NTTF

SEQ ID NO: 270 - protein, 15 aa, Homo sapiens
FLLETAAYLDYESTK

SEQ ID NO: 271 - protein, 15 aa, Homo sapiens
ETAAYLDYESTKEYA

SEQ ID NO: 272 - protein, 15 aa, Homo sapiens
ITVTDPDYGDNSAVT

SEQ ID NO: 273 - protein, 4 aa, Homo sapiens
RKST

SEQ ID NO: 274 - protein, 4 aa, Homo sapiens
KKHS

SEQ ID NO: 275 - protein, 4 aa, Homo sapiens
TIRE

SEQ ID NO: 276 - protein, 4 aa, Homo sapiens
SIPE

SEQ ID NO: 277 - protein, 4 aa, Homo sapiens
SVTD

SEQ ID NO: 278 - protein, 4 aa, Homo sapiens
TEIE

SEQ ID NO: 279 - protein, 4 aa, Homo sapiens
SIPE

SEQ ID NO: 280 - protein, 4 aa, Homo sapiens
TDAD

SEQ ID NO: 281 - protein, 4 aa, Homo sapiens
TIKE

SEQ ID NO: 282 - protein, 4 aa, Homo sapiens
TVTD

SEQ ID NO: 283 - protein, 4 aa, Homo sapiens
TDKD

SEQ ID NO: 284 - protein, 4 aa, Homo sapiens
TDHE

SEQ ID NO: 285 - protein, 4 aa, Homo sapiens
STKE

SEQ ID NO: 286 - protein, 4 aa, Homo sapiens
SIPE

SEQ ID NO: 287 - protein, 4 aa, Homo sapiens
SAMD

SEQ ID NO: 288 - protein, 4 aa, Homo sapiens
SIID

SEQ ID NO: 289 - protein, 4 aa, Homo sapiens
THNE

SEQ ID NO: 290 - protein, 4 aa, Homo sapiens
TVTD

SEQ ID NO: 291 - protein, 4 aa, Homo sapiens
TDPD

SEQ ID NO: 292 - protein, 4 aa, Homo sapiens
SILD

SEQ ID NO: 293 - protein, 4 aa, Homo sapiens
TLME

SEQ ID NO: 294 - protein, 4 aa, Homo sapiens
TIEE

SEQ ID NO: 295 - protein, 4 aa, Homo sapiens
TKAD

SEQ ID NO: 296 - protein, 4 aa, Homo sapiens
SSSD

SEQ ID NO: 297 - protein, 4 aa, Homo sapiens
SVSD

SEQ ID NO: 298 - protein, 4 aa, Homo sapiens
TTFE

SEQ ID NO: 299 - protein, 6 aa, Homo sapiens
GTSVTQ

SEQ ID NO: 300 - protein, 6 aa, Homo sapiens
GLMPAR

SEQ ID NO: 301 - protein, 6 aa, Homo sapiens
GIQLTK

SEQ ID NO: 302 - protein, 6 aa, Homo sapiens
GGRVSR

SEQ ID NO: 303 - protein, 6 aa, Homo sapiens
GQPDSL

SEQ ID NO: 304 - protein, 6 aa, Homo sapiens
GNRVTL

SEQ ID NO: 305 - protein, 6 aa, Homo sapiens
GIQVSN

SEQ ID NO: 306 - protein, 11 aa, Homo sapiens
VSVTDTNDNHP

SEQ ID NO: 307 - protein, 11 aa, Homo sapiens
VNVTDVNDNVP

SEQ ID NO: 308 - protein, 11 aa, Homo sapiens
IKVKDENDNAP

SEQ ID NO: 309 - protein, 11 aa, Homo sapiens
VSIIDQNDNSP

SEQ ID NO: 310 - protein, 11 aa, Homo sapiens
INVVDVNDNKP

SEQ ID NO: 311 - protein, 752 aa, Homo sapiens
PATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKNYTIREEMPENVLIGDLLKDLNLSLIPNKPSLTTAMQFKLVYKTGDVPLIRIEEDTGEIFTTGARIDREKLCAGIPRDEHCFYEVEVAILPDEIFRLVKIRFLIEDINDNAPLFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSINPVNDTVVLSENIPLNTKIALITVTDKDADHNGRVTCFTDHEIPFRLRPVFSNQFLLETAAYLDYESTKEYAIKLLAADAGPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFVLPSTNPGTVVFQVIAVDNDTGMNAEVCYSIVGGNTRDLFAIDQETGNITLMEKCDVTDLGLHRVLVKANDLGQPDSLFSVVIVNLFVNESVTNATLINELVRKSTEAPVT

SEQ ID NO: 312 - protein, 4 aa, Homo sapiens
NSSR

SEQ ID NO: 313 - protein, 4 aa, Homo sapiens
RRTT

SEQ ID NO: 314 - protein, 4 aa, Homo sapiens
RKGS

SEQ ID NO: 315 - protein, 4 aa, Homo sapiens
TITE

SEQ ID NO: 316 - protein, 4 aa, Homo sapiens
STLD

SEQ ID NO: 317 - protein, 6 aa, Homo sapiens
GAAGAT

SEQ ID NO: 318 - protein, 6 aa, Homo sapiens
GVSATL

SEQ ID NO: 319 - protein, 6 aa, Homo sapiens
GGAAGH

SEQ ID NO: 320 - protein, 6 aa, Homo sapiens
GSAVSA

SEQ ID NO: 321 - protein, 6 aa, Homo sapiens
GGDAGV

SEQ ID NO: 322 - protein, 6 aa, Homo sapiens
GVQICL

SEQ ID NO: 323 - protein, 6 aa, Homo sapiens
GICVSS

SEQ ID NO: 324 - protein, 6 aa, Homo sapiens
GNDHST

SEQ ID NO: 325 - protein, 6 aa, Homo sapiens
GQEGSV

SEQ ID NO: 326 - protein, 6 aa, Homo sapiens
GLCCAR

SEQ ID NO: 327 - protein, 6 aa, Homo sapiens
GQVCTK

SEQ ID NO: 328 - protein, 4 aa, Homo sapiens
NSSR

SEQ ID NO: 329 - protein, 4 aa, Homo sapiens
NASE

SEQ ID NO: 330 - protein, 4 aa, Homo sapiens
NASE

SEQ ID NO: 331 - protein, 4 aa, Homo sapiens
NASE

SEQ ID NO: 332 - protein, 4 aa, Homo sapiens
RRTT

SEQ ID NO: 333 - protein, 4 aa, Homo sapiens
RKGS

SEQ ID NO: 334 - protein, 4 aa, Homo sapiens
RRSS

SEQ ID NO: 335 - protein, 4 aa, Homo sapiens
SRPD

SEQ ID NO: 336 - protein, 4 aa, Homo sapiens
SITE

SEQ ID NO: 337 - protein, 4 aa, Homo sapiens
SITE

SEQ ID NO: 338 - protein, 4 aa, Homo sapiens
SITE

SEQ ID NO: 339 - protein, 4 aa, Homo sapiens
SITE

SEQ ID NO: 340 - protein, 4 aa, Homo sapiens
SRPD

SEQ ID NO: 341 - protein, 4 aa, Homo sapiens
SITE

SEQ ID NO: 342 - protein, 4 aa, Homo sapiens
SITE

SEQ ID NO: 343 - protein, 4 aa, Homo sapiens
TITE

SEQ ID NO: 344 - protein, 4 aa, Homo sapiens
STLD

SEQ ID NO: 345 - protein, 4 aa, Homo sapiens
SITE

SEQ ID NO: 346 - protein, 4 aa, Homo sapiens
SGND

SEQ ID NO: 347 - protein, 4 aa, Homo sapiens
TGQE

SEQ ID NO: 348 - protein, 6 aa, Homo sapiens
GAAGAT

SEQ ID NO: 349 - protein, 6 aa, Homo sapiens
GVSATL

SEQ ID NO: 350 - protein, 6 aa, Homo sapiens
GGAAGH

SEQ ID NO: 351 - protein, 6 aa, Homo sapiens
GSAVSA

SEQ ID NO: 352 - protein, 6 aa, Homo sapiens
GGDAGV

SEQ ID NO: 353 - protein, 6 aa, Homo sapiens
GVQICL

SEQ ID NO: 354 - protein, 6 aa, Homo sapiens
GICVSS

SEQ ID NO: 355 - protein, 6 aa, Homo sapiens
GNDHST

SEQ ID NO: 356 - protein, 6 aa, Homo sapiens
GQEGSV

SEQ ID NO: 357 - protein, 6 aa, Homo sapiens
GLCCAR

SEQ ID NO: 358 - protein, 6 aa, Homo sapiens
GQVCTK

SEQ ID NO: 359 - protein, 4 aa, Homo sapiens
NLTL

SEQ ID NO: 360 - protein, 4 aa, Homo sapiens
NRSD

SEQ ID NO: 361 - protein, 4 aa, Homo sapiens
NTTL

SEQ ID NO: 362 - protein, 4 aa, Homo sapiens
NKTS

SEQ ID NO: 363 - protein, 4 aa, Homo sapiens
NQSI

SEQ ID NO: 364 - protein, 4 aa, Homo sapiens
SHLD

SEQ ID NO: 365 - protein, 4 aa, Homo sapiens
TRSE

SEQ ID NO: 366 - protein, 9 aa, Homo sapiens
KPFGDSRMY

SEQ ID NO: 367 - protein, 6 aa, Homo sapiens
RRSRIY

SEQ ID NO: 368 - protein, 6 aa, Homo sapiens
GCYIAI

SEQ ID NO: 369 - protein, 17 aa, Homo sapiens
TSIVFLGLISIDRYLKV

SEQ ID NO: 370 - protein, 256 aa, Homo sapiens
LNGLAVWIFFHIRNKTSFIFYLKNIVVADLIMTLTFPFRIVHDAGFGPWYFKFILCRYTSVLFYANMYTSIVFLGLISIDRYLKVVKPFGDSRMYSITFTKVLSVCVWVIMAVLSLPNIILTNGQPTEDNIHDCSKLKSPLGVKWHTAVTYVNSCLFVAVLVILIGCYIAISRYIHKSSRQFISQSSRKRKHNQSIRVVVAVFFTCFLPYHLCRIPFTFSHLDRLLDESAQKILYYCKEITLFLSACNVCLDPIIY

SEQ ID NO: 371 - protein, 4 aa, Homo sapiens
NVTQ

SEQ ID NO: 372 - protein, 4 aa, Homo sapiens
NHTL

SEQ ID NO: 373 - protein, 15 aa, Homo sapiens
AWDTNEEYLFKAMVA

SEQ ID NO: 374 - protein, 4 aa, Homo sapiens
TNEE

SEQ ID NO: 375 - protein, 4 aa, Homo sapiens
SEVD

SEQ ID NO: 376 - protein, 4 aa, Homo sapiens
TEDE

SEQ ID NO: 377 - protein, 6 aa, Homo sapiens
GAENAF

SEQ ID NO: 378 - protein, 6 aa, Homo sapiens
GVIFCI

SEQ ID NO: 379 - protein, 6 aa, Homo sapiens
GGHIND

SEQ ID NO: 380 - protein, 4 aa, Homo sapiens
TLRE

SEQ ID NO: 381 - protein, 6 aa, Homo sapiens
GGPLAL

SEQ ID NO: 382 - protein, 6 aa, Homo sapiens
GMVGAL

SEQ ID NO: 383 - protein, 6 aa, Homo sapiens
GIAKAL

SEQ ID NO: 384 - protein, 4 aa, Homo sapiens
RRHT

SEQ ID NO: 385 - protein, 6 aa, Homo sapiens
GNPPTG

SEQ ID NO: 386 - protein, 6 aa, Homo sapiens
GSPPGG

SEQ ID NO: 387 - protein, 6 aa, Homo sapiens
GGFLGS

SEQ ID NO: 388 - protein, 6 aa, Homo sapiens
GQDVSR

SEQ ID NO: 389 - protein, 6 aa, Homo sapiens
GATLSA

SEQ ID NO: 390 - protein, 6 aa, Homo sapiens
GILGGV

SEQ ID NO: 391 - protein, 6 aa, Homo sapiens
GSRACT

SEQ ID NO: 392 - protein, 4 aa, Homo sapiens
NFTL

SEQ ID NO: 393 - protein, 4 aa, Homo sapiens
NSSI

SEQ ID NO: 394 - protein, 15 aa, Homo sapiens
RLFDETHYPDAFMRE

SEQ ID NO: 395 - protein, 4 aa, Homo sapiens
SQFE

SEQ ID NO: 396 - protein, 4 aa, Homo sapiens
SIAD

SEQ ID NO: 397 - protein, 6 aa, Homo sapiens
GLSEAR

SEQ ID NO: 398 - protein, 6 aa, Homo sapiens
GVLIGA

SEQ ID NO: 399 - protein, 6 aa, Homo sapiens
GLPLAT

SEQ ID NO: 400 - protein, 24 aa, Homo sapiens
LSQRLGLSEARVQVWFQNRRAKCR

SEQ ID NO: 401 - protein, 61 aa, Homo sapiens
IKQRRSRTNFTLEQLNELERLFDETHYPDAFMREELSQRLGLSEARVQVWFQNRRAKCRKQ

SEQ ID NO: 402 - protein, 14 aa, Homo sapiens
SSIADLRLKAKKHA

SEQ ID NO: 403 - protein, 4 aa, Homo sapiens
NTTG

SEQ ID NO: 404 - protein, 4 aa, Homo sapiens
NLTD

SEQ ID NO: 405 - protein, 4 aa, Homo sapiens
SYAE

SEQ ID NO: 406 - protein, 4 aa, Homo sapiens
SGSD

SEQ ID NO: 407 - protein, 4 aa, Homo sapiens
SKRD

SEQ ID NO: 408 - protein, 4 aa, Homo sapiens
SQLD

SEQ ID NO: 409 - protein, 4 aa, Homo sapiens
SWGD

SEQ ID NO: 410 - protein, 4 aa, Homo sapiens
SVKE

SEQ ID NO: 411 - protein, 4 aa, Homo sapiens
SGPE

SEQ ID NO: 412 - protein, 4 aa, Homo sapiens
SALD

SEQ ID NO: 413 - protein, 4 aa, Homo sapiens
SFPE

SEQ ID NO: 414 - protein, 4 aa, Homo sapiens
SPNE

SEQ ID NO: 415 - protein, 4 aa, Homo sapiens
SPSE

SEQ ID NO: 416 - protein, 4 aa, Homo sapiens
SESE

SEQ ID NO: 417 - protein, 4 aa, Homo sapiens
SEKE

SEQ ID NO: 418 - protein, 4 aa, Homo sapiens
SSPD

SEQ ID NO: 419 - protein, 4 aa, Homo sapiens
SDNE

SEQ ID NO: 420 - protein, 9 aa, Homo sapiens
KSGPEAALY

SEQ ID NO: 421 - protein, 6 aa, Homo sapiens
GSDFNC

SEQ ID NO: 422 - protein, 6 aa, Homo sapiens
GVMRGC

SEQ ID NO: 423 - protein, 6 aa, Homo sapiens
GLAPSL

SEQ ID NO: 424 - protein, 6 aa, Homo sapiens
GSSPSL

SEQ ID NO: 425 - protein, 6 aa, Homo sapiens
GGKVSF

SEQ ID NO: 426 - protein, 6 aa, Homo sapiens
GNWLTA

SEQ ID NO: 427 - protein, 4 aa, Homo sapiens
SGRK

SEQ ID NO: 428 - protein, 24 aa, Homo sapiens
ISKTINLTDRQVKIWFQNRRMKLK

SEQ ID NO: 429 - protein, 61 aa, Homo sapiens
KSGRKKRCPYTKHQTLELEKEFLFNMYLTRERRLEISKTINLTDRQVKIWFQNRRMKLKKM

SEQ ID NO: 430 - protein, 4 aa, Homo sapiens
NATL

SEQ ID NO: 431 - protein, 4 aa, Homo sapiens
NTSM

SEQ ID NO: 432 - protein, 4 aa, Homo sapiens
NLTL

SEQ ID NO: 433 - protein, 4 aa, Homo sapiens
NASF

SEQ ID NO: 434 - protein, 4 aa, Homo sapiens
NLTC

SEQ ID NO: 435 - protein, 4 aa, Homo sapiens
NQTQ

SEQ ID NO: 436 - protein, 4 aa, Homo sapiens
THPD

SEQ ID NO: 437 - protein, 4 aa, Homo sapiens
THGD

SEQ ID NO: 438 - protein, 4 aa, Homo sapiens
TQNE

SEQ ID NO: 439 - protein, 4 aa, Homo sapiens
SSFD

SEQ ID NO: 440 - protein, 6 aa, Homo sapiens
GLKPAS

SEQ ID NO: 441 - protein, 6 aa, Homo sapiens
GIRTSG

SEQ ID NO: 442 - protein, 17 aa, Homo sapiens
RRELLRRTWGRERKVRG

SEQ ID NO: 443 - protein, 32 aa, Homo sapiens
MKYLRHRRPNATLILAIGAFTLLLFSLLVSPP

SEQ ID NO: 444 - protein, 4 aa, Homo sapiens
NLSS

SEQ ID NO: 445 - protein, 4 aa, Homo sapiens
NFTI

SEQ ID NO: 446 - protein, 15 aa, Homo sapiens
GRAVQAVYEDMDARK

SEQ ID NO: 447 - protein, 4 aa, Homo sapiens
TKYD

SEQ ID NO: 448 - protein, 4 aa, Homo sapiens
SPGE

SEQ ID NO: 449 - protein, 4 aa, Homo sapiens
TFLE

SEQ ID NO: 450 - protein, 4 aa, Homo sapiens
SEEE

SEQ ID NO: 451 - protein, 4 aa, Homo sapiens
SGLE

SEQ ID NO: 452 - protein, 4 aa, Homo sapiens
SFLE

SEQ ID NO: 453 - protein, 4 aa, Homo sapiens
SAEE

SEQ ID NO: 454 - protein, 4 aa, Homo sapiens
TDGD

SEQ ID NO: 455 - protein, 4 aa, Homo sapiens
SGAD

SEQ ID NO: 456 - protein, 4 aa, Homo sapiens
SAQE

SEQ ID NO: 457 - protein, 6 aa, Homo sapiens
GLPFSS

SEQ ID NO: 458 - protein, 6 aa, Homo sapiens
GSGKST

SEQ ID NO: 459 - protein, 6 aa, Homo sapiens
GSCLCL

SEQ ID NO: 460 - protein, 6 aa, Homo sapiens
GVILSE

SEQ ID NO: 461 - protein, 6 aa, Homo sapiens
GADEAW

SEQ ID NO: 462 - protein, 6 aa, Homo sapiens
GLNWAA

SEQ ID NO: 463 - protein, 6 aa, Homo sapiens
GSEQNR

SEQ ID NO: 464 - protein, 6 aa, Homo sapiens
GMADST

SEQ ID NO: 465 - protein, 6 aa, Homo sapiens
GSKSSS

SEQ ID NO: 466 - protein, 8 aa, Homo sapiens
GEPGSGKS

SEQ ID NO: 467 - protein, 4 aa, Homo sapiens
CVLQ

SEQ ID NO: 468 - protein, 4 aa, Homo sapiens
NKSW

SEQ ID NO: 469 - protein, 4 aa, Homo sapiens
NLSD

SEQ ID NO: 470 - protein, 4 aa, Homo sapiens
NGSR

SEQ ID NO: 471 - protein, 4 aa, Homo sapiens
NRTS

SEQ ID NO: 472 - protein, 4 aa, Homo sapiens
NQTV

SEQ ID NO: 473 - protein, 15 aa, Homo sapiens
LSPDDLKYIEEFNKS

SEQ ID NO: 474 - protein, 4 aa, Homo sapiens
KKES

SEQ ID NO: 475 - protein, 4 aa, Homo sapiens
SSTE

SEQ ID NO: 476 - protein, 4 aa, Homo sapiens
SISE

SEQ ID NO: 477 - protein, 4 aa, Homo sapiens
SEIE

SEQ ID NO: 478 - protein, 4 aa, Homo sapiens
SPRD

SEQ ID NO: 479 - protein, 4 aa, Homo sapiens
SDAE

SEQ ID NO: 480 - protein, 4 aa, Homo sapiens
SDGE

SEQ ID NO: 481 - protein, 4 aa, Homo sapiens
SDSE

SEQ ID NO: 482 - protein, 4 aa, Homo sapiens
TDTD

SEQ ID NO: 483 - protein, 4 aa, Homo sapiens
TLHE

SEQ ID NO: 484 - protein, 4 aa, Homo sapiens
TWSD

SEQ ID NO: 485 - protein, 4 aa, Homo sapiens
TEGE

SEQ ID NO: 486 - protein, 4 aa, Homo sapiens
SSAE

SEQ ID NO: 487 - protein, 4 aa, Homo sapiens
SASE

SEQ ID NO: 488 - protein, 4 aa, Homo sapiens
SLDD

SEQ ID NO: 489 - protein, 4 aa, Homo sapiens
SMSE

SEQ ID NO: 490 - protein, 4 aa, Homo sapiens
SSKE

SEQ ID NO: 491 - protein, 4 aa, Homo sapiens
SKED

SEQ ID NO: 492 - protein, 4 aa, Homo sapiens
SPDD

SEQ ID NO: 493 - protein, 4 aa, Homo sapiens
TSPE

SEQ ID NO: 494 - protein, 4 aa, Homo sapiens
SPGD

SEQ ID NO: 495 - protein, 4 aa, Homo sapiens
TTRE

SEQ ID NO: 496 - protein, 4 aa, Homo sapiens
TIND

SEQ ID NO: 497 - protein, 4 aa, Homo sapiens
TLTE

SEQ ID NO: 498 - protein, 4 aa, Homo sapiens
SLGD

SEQ ID NO: 499 - protein, 6 aa, Homo sapiens
GASPGA

SEQ ID NO: 500 - protein, 6 aa, Homo sapiens
GAGGGA

SEQ ID NO: 501 - protein, 6 aa, Homo sapiens
GLRGGA

SEQ ID NO: 502 - protein, 6 aa, Homo sapiens
GTINAK

SEQ ID NO: 503 - protein, 6 aa, Homo sapiens
GGQTCF

SEQ ID NO: 504 - protein, 6 aa, Homo sapiens
GVQGGH

SEQ ID NO: 505 - protein, 6 aa, Homo sapiens
GGHQAD

SEQ ID NO: 506 - protein, 6 aa, Homo sapiens
GSFLCD

SEQ ID NO: 507 - protein, 6 aa, Homo sapiens
GLPSTS

SEQ ID NO: 508 - protein, 6 aa, Homo sapiens
GSGVTS

SEQ ID NO: 509 - protein, 6 aa, Homo sapiens
GLRAGS

SEQ ID NO: 510 - protein, 6 aa, Homo sapiens
GQETGT

SEQ ID NO: 511 - protein, 6 aa, Homo sapiens
GSEMCR

SEQ ID NO: 512 - protein, 4 aa, Homo sapiens
AGKK

SEQ ID NO: 513 - protein, 4 aa, Homo sapiens
NKSW

SEQ ID NO: 514 - protein, 4 aa, Homo sapiens
NLSD

SEQ ID NO: 515 - protein, 4 aa, Homo sapiens
NGSR

SEQ ID NO: 516 - protein, 15 aa, Homo sapiens
LSPDDLKYIEEFNKS

SEQ ID NO: 517 - protein, 4 aa, Homo sapiens
KKES

SEQ ID NO: 518 - protein, 4 aa, Homo sapiens
SSTE

SEQ ID NO: 519 - protein, 4 aa, Homo sapiens
SISE

SEQ ID NO: 520 - protein, 4 aa, Homo sapiens
SEIE

SEQ ID NO: 521 - protein, 4 aa, Homo sapiens
SPRD

SEQ ID NO: 522 - protein, 4 aa, Homo sapiens
SDAE

SEQ ID NO: 523 - protein, 4 aa, Homo sapiens
SDGE

SEQ ID NO: 524 - protein, 4 aa, Homo sapiens
SDSE

SEQ ID NO: 525 - protein, 4 aa, Homo sapiens
TDTD

SEQ ID NO: 526 - protein, 4 aa, Homo sapiens
TLHE

SEQ ID NO: 527 - protein, 4 aa, Homo sapiens
TWSD

SEQ ID NO: 528 - protein, 4 aa, Homo sapiens
TEGE

SEQ ID NO: 529 - protein, 4 aa, Homo sapiens
SSAE

SEQ ID NO: 530 - protein, 4 aa, Homo sapiens
SASE

SEQ ID NO: 531 - protein, 4 aa, Homo sapiens
SLDD

SEQ ID NO: 532 - protein, 4 aa, Homo sapiens
SMSE

SEQ ID NO: 533 - protein, 4 aa, Homo sapiens
SSKE

SEQ ID NO: 534 - protein, 4 aa, Homo sapiens
SKED

SEQ ID NO: 535 - protein, 4 aa, Homo sapiens
SPDD

SEQ ID NO: 536 - protein, 4 aa, Homo sapiens
TSPE

SEQ ID NO: 537 - protein, 4 aa, Homo sapiens
SPGD

SEQ ID NO: 538 - protein, 6 aa, Homo sapiens
GASPGA

SEQ ID NO: 539 - protein, 6 aa, Homo sapiens
GAGGGA

SEQ ID NO: 540 - protein, 6 aa, Homo sapiens
GLRGGA

SEQ ID NO: 541 - protein, 6 aa, Homo sapiens
GTINAK

SEQ ID NO: 542 - protein, 6 aa, Homo sapiens
GGQTCF

SEQ ID NO: 543 - protein, 6 aa, Homo sapiens
GVQGGH

SEQ ID NO: 544 - protein, 6 aa, Homo sapiens
GGHQAD

SEQ ID NO: 545 - protein, 6 aa, Homo sapiens
GSFLCD

SEQ ID NO: 546 - protein, 6 aa, Homo sapiens
GLPSTS

SEQ ID NO: 547 - protein, 6 aa, Homo sapiens
GSGVTS

SEQ ID NO: 548 - protein, 4 aa, Homo sapiens
AGKK

SEQ ID NO: 549 - protein, 4 aa, Homo sapiens
NKSW

SEQ ID NO: 550 - protein, 4 aa, Homo sapiens
NLSD

SEQ ID NO: 551 - protein, 4 aa, Homo sapiens
NGSR

SEQ ID NO: 552 - protein, 4 aa, Homo sapiens
NRTS

SEQ ID NO: 553 - protein, 15 aa, Homo sapiens
LSPDDLKYIEEFNKS

SEQ ID NO: 554 - protein, 4 aa, Homo sapiens
KKES

SEQ ID NO: 555 - protein, 4 aa, Homo sapiens
SSTE

SEQ ID NO: 556 - protein, 4 aa, Homo sapiens
SISE

SEQ ID NO: 557 - protein, 4 aa, Homo sapiens
SEIE

SEQ ID NO: 558 - protein, 4 aa, Homo sapiens
SPRD

SEQ ID NO: 559 - protein, 4 aa, Homo sapiens
SDAE

SEQ ID NO: 560 - protein, 4 aa, Homo sapiens
SDGE

SEQ ID NO: 561 - protein, 4 aa, Homo sapiens
SDSE

SEQ ID NO: 562 - protein, 4 aa, Homo sapiens
TDTD

SEQ ID NO: 563 - protein, 4 aa, Homo sapiens
TLHE

SEQ ID NO: 564 - protein, 4 aa, Homo sapiens
TWSD

SEQ ID NO: 565 - protein, 4 aa, Homo sapiens
TEGE

SEQ ID NO: 566 - protein, 4 aa, Homo sapiens
SSAE

SEQ ID NO: 567 - protein, 4 aa, Homo sapiens
SASE

SEQ ID NO: 568 - protein, 4 aa, Homo sapiens
SLDD

SEQ ID NO: 569 - protein, 4 aa, Homo sapiens
SMSE

SEQ ID NO: 570 - protein, 4 aa, Homo sapiens
SSKE

SEQ ID NO: 571 - protein, 4 aa, Homo sapiens
SKED

SEQ ID NO: 572 - protein, 4 aa, Homo sapiens
SPDD

SEQ ID NO: 573 - protein, 4 aa, Homo sapiens
TSPE

SEQ ID NO: 574 - protein, 4 aa, Homo sapiens
SPGD

SEQ ID NO: 575 - protein, 4 aa, Homo sapiens
TTRE

SEQ ID NO: 576 - protein, 4 aa, Homo sapiens
TIND

SEQ ID NO: 577 - protein, 4 aa, Homo sapiens
TLTE

SEQ ID NO: 578 - protein, 4 aa, Homo sapiens
SLGD

SEQ ID NO: 579 - protein, 6 aa, Homo sapiens
GASPGA

SEQ ID NO: 580 - protein, 6 aa, Homo sapiens
GAGGGA

SEQ ID NO: 581 - protein, 6 aa, Homo sapiens
GLRGGA

SEQ ID NO: 582 - protein, 6 aa, Homo sapiens
GTINAK

SEQ ID NO: 583 - protein, 6 aa, Homo sapiens
GGQTCF

SEQ ID NO: 584 - protein, 6 aa, Homo sapiens
GVQGGH

SEQ ID NO: 585 - protein, 6 aa, Homo sapiens
GGHQAD

SEQ ID NO: 586 - protein, 6 aa, Homo sapiens
GLPSTS

SEQ ID NO: 587 - protein, 6 aa, Homo sapiens
GSGVTS

SEQ ID NO: 588 - protein, 6 aa, Homo sapiens
GLRAGS

SEQ ID NO: 589 - protein, 6 aa, Homo sapiens
GQETGT

SEQ ID NO: 590 - protein, 6 aa, Homo sapiens
GSEMCR

SEQ ID NO: 591 - protein, 4 aa, Homo sapiens
AGKK

SEQ ID NO: 592 - protein, 4 aa, Homo sapiens
NKSV

SEQ ID NO: 593 - protein, 4 aa, Homo sapiens
NGSL

SEQ ID NO: 594 - protein, 15 aa, Homo sapiens
QEQTDFAYDSDVTGC

SEQ ID NO: 595 - protein, 4 aa, Homo sapiens
SLRE

SEQ ID NO: 596 - protein, 4 aa, Homo sapiens
SAYD

SEQ ID NO: 597 - protein, 4 aa, Homo sapiens
SPGD

SEQ ID NO: 598 - protein, 4 aa, Homo sapiens
SEED

SEQ ID NO: 599 - protein, 4 aa, Homo sapiens
SHLD

SEQ ID NO: 600 - protein, 9 aa, Homo sapiens
KVAGERYVY

SEQ ID NO: 601 - protein, 6 aa, Homo sapiens
GAGAAL

SEQ ID NO: 602 - protein, 6 aa, Homo sapiens
GSRACS

SEQ ID NO: 603 - protein, 6 aa, Homo sapiens
GGVNGH

SEQ ID NO: 604 - protein, 6 aa, Homo sapiens
GIQKNR

SEQ ID NO: 605 - protein, 9 aa, Homo sapiens
LWQFLVALL

SEQ ID NO: 606 - protein, 16 aa, Homo sapiens
RPAMNYDKLSRSLRYY

SEQ ID NO: 607 - protein, 81 aa, Homo sapiens
LQLWQFLVALLDDPTNAHFIAWTGRGMEFKLIEPEEVARLWGIQKNRPAMNYDKLSRSLRYYYEKGIMQKVAGERYVYKFV

SEQ ID NO: 608 - protein, 4 aa, Homo sapiens
NVSN

SEQ ID NO: 609 - protein, 4 aa, Homo sapiens
NETS

SEQ ID NO: 610 - protein, 4 aa, Homo sapiens
NCST

SEQ ID NO: 611 - protein, 4 aa, Homo sapiens
SPEE

SEQ ID NO: 612 - protein, 4 aa, Homo sapiens
TGKD

SEQ ID NO: 613 - protein, 4 aa, Homo sapiens
TMGD

SEQ ID NO: 614 - protein, 4 aa, Homo sapiens
TLKD

SEQ ID NO: 615 - protein, 4 aa, Homo sapiens
TELE

SEQ ID NO: 616 - protein, 4 aa, Homo sapiens
TLPE

SEQ ID NO: 617 - protein, 4 aa, Homo sapiens
TTRD

SEQ ID NO: 618 - protein, 4 aa, Homo sapiens
TCEE

SEQ ID NO: 619 - protein, 6 aa, Homo sapiens
GLAGGK

SEQ ID NO: 620 - protein, 6 aa, Homo sapiens
GAGATG

SEQ ID NO: 621 - protein, 6 aa, Homo sapiens
GTPFSY

SEQ ID NO: 622 - protein, 6 aa, Homo sapiens
GMWEAF

SEQ ID NO: 623 - protein, 6 aa, Homo sapiens
GTGENL

SEQ ID NO: 624 - protein, 22 aa, Homo sapiens
LGELERQLLRKVAELEDEKSLL

SEQ ID NO: 625 - protein, 8 aa, Homo sapiens
HICVTWTT

SEQ ID NO: 626 - protein, 4 aa, Homo sapiens
KKRT

SEQ ID NO: 627 - protein, 4 aa, Homo sapiens
KRTS

SEQ ID NO: 628 - protein, 4 aa, Homo sapiens
KRMT

SEQ ID NO: 629 - protein, 4 aa, Homo sapiens
SDED

SEQ ID NO: 630 - protein, 4 aa, Homo sapiens
TSDD

SEQ ID NO: 631 - protein, 4 aa, Homo sapiens
TQAD

SEQ ID NO: 632 - protein, 4 aa, Homo sapiens
TSID

SEQ ID NO: 633 - protein, 4 aa, Homo sapiens
TSIE

SEQ ID NO: 634 - protein, 4 aa, Homo sapiens
SAQE

SEQ ID NO: 635 - protein, 4 aa, Homo sapiens
TPDD

SEQ ID NO: 636 - protein, 6 aa, Homo sapiens
GAGGGG

SEQ ID NO: 637 - protein, 6 aa, Homo sapiens
GGGGGG

SEQ ID NO: 638 - protein, 6 aa, Homo sapiens
GGGGGG

SEQ ID NO: 639 - protein, 6 aa, Homo sapiens
GGGGGG

SEQ ID NO: 640 - protein, 6 aa, Homo sapiens
GGGGGG

SEQ ID NO: 641 - protein, 6 aa, Homo sapiens
GGGGGS

SEQ ID NO: 642 - protein, 6 aa, Homo sapiens
GGGGSG

SEQ ID NO: 643 - protein, 6 aa, Homo sapiens
GGGSGG

SEQ ID NO: 644 - protein, 6 aa, Homo sapiens
GGSGGG

SEQ ID NO: 645 - protein, 6 aa, Homo sapiens
GSGGGG

SEQ ID NO: 646 - protein, 6 aa, Homo sapiens
GGGGAG

SEQ ID NO: 647 - protein, 6 aa, Homo sapiens
GGGAGG

SEQ ID NO: 648 - protein, 6 aa, Homo sapiens
GGAGGG

SEQ ID NO: 649 - protein, 6 aa, Homo sapiens
GAGGGG

SEQ ID NO: 650 - protein, 6 aa, Homo sapiens
GGGGGG

SEQ ID NO: 651 - protein, 6 aa, Homo sapiens
GGGGGM

SEQ ID NO: 652 - protein, 6 aa, Homo sapiens
GMQPGS

SEQ ID NO: 653 - protein, 6 aa, Homo sapiens
GAYRGD

SEQ ID NO: 654 - protein, 6 aa, Homo sapiens
GAMAAS

SEQ ID NO: 655 - protein, 6 aa, Homo sapiens
GSAVGM

SEQ ID NO: 656 - protein, 6 aa, Homo sapiens
GGWGAA

SEQ ID NO: 657 - protein, 6 aa, Homo sapiens
GAAAAA

SEQ ID NO: 658 - protein, 6 aa, Homo sapiens
GGGGGG

SEQ ID NO: 659 - protein, 6 aa, Homo sapiens
GGGGGA

SEQ ID NO: 660 - protein, 6 aa, Homo sapiens
GGGGAG

SEQ ID NO: 661 - protein, 6 aa, Homo sapiens
GGGAGG

SEQ ID NO: 662 - protein, 6 aa, Homo sapiens
GGAGGG

SEQ ID NO: 663 - protein, 6 aa, Homo sapiens
GAGGGA

SEQ ID NO: 664 - protein, 6 aa, Homo sapiens
GGAQSL

SEQ ID NO: 665 - protein, 6 aa, Homo sapiens
GLVRGD

SEQ ID NO: 666 - protein, 6 aa, Homo sapiens
GGGGGG

SEQ ID NO: 667 - protein, 6 aa, Homo sapiens
GGGGGA

SEQ ID NO: 668 - protein, 6 aa, Homo sapiens
GGGGAG

SEQ ID NO: 669 - protein, 6 aa, Homo sapiens
GAGPGL

SEQ ID NO: 670 - protein, 6 aa, Homo sapiens
GLALGT

SEQ ID NO: 671 - protein, 6 aa, Homo sapiens
GTLYGN

SEQ ID NO: 672 - protein, 6 aa, Homo sapiens
GNVFSQ

SEQ ID NO: 673 - protein, 6 aa, Homo sapiens
GSPTSI

SEQ ID NO: 674 - protein, 6 aa, Homo sapiens
GALESH

SEQ ID NO: 675 - protein, 6 aa, Homo sapiens
GTVSAD

SEQ ID NO: 676 - protein, 6 aa, Homo sapiens
GLQTSV

SEQ ID NO: 677 - protein, 4 aa, Homo sapiens
QGRK

SEQ ID NO: 678 - protein, 24 aa, Homo sapiens
LADSLQLEKEVVRVWFCNRRQKEK

SEQ ID NO: 679 - protein, 61 aa, Homo sapiens
GRKRKKRTSIEVSVKGALESHFLKCPKPSAQEITNLADSLQLEKEVVRVWFCNRRQKEKRM

SEQ ID NO: 680 - protein, 13 aa, Homo sapiens
RRIKLGFTQADVG

SEQ ID NO: 681 - protein, 14 aa, Homo sapiens
SQTTICRFEALQLS

SEQ ID NO: 682 - protein, 4 aa, Homo sapiens
SEAE

SEQ ID NO: 683 - protein, 4 aa, Homo sapiens
TPGE

SEQ ID NO: 684 - protein, 4 aa, Homo sapiens
TFQE

SEQ ID NO: 685 - protein, 4 aa, Homo sapiens
SWFE

SEQ ID NO: 686 - protein, 4 aa, Homo sapiens
TMVE

SEQ ID NO: 687 - protein, 4 aa, Homo sapiens
SMNE

SEQ ID NO: 688 - protein, 9 aa, Homo sapiens
RFMNDKLGY

SEQ ID NO: 689 - protein, 180 aa, Homo sapiens [sequence omitted]

SEQ ID NO: 690 - protein, 228 aa, Homo sapiens [sequence omitted]

SEQ ID NO: 691 - protein, 1328 aa, Homo sapiens; identical to SEQ ID NO: 24

SEQ ID NO: 692 - protein, 1021 aa, Homo sapiens; identical to SEQ ID NO: 26

SEQ ID NO: 693 - protein, 123 aa, Homo sapiens; identical to SEQ ID NO: 30

SEQ ID NO: 694 - protein, 266 aa, Homo sapiens; identical to SEQ ID NO: 28

SEQ ID NO: 695 - protein, 358 aa, Homo sapiens; identical to SEQ ID NO: 32

SEQ ID NO: 696 - protein, 222 aa, Homo sapiens; identical to SEQ ID NO: 34

SEQ ID NO: 697 - protein, 227 aa, Homo sapiens; identical to SEQ ID NO: 36

SEQ ID NO: 698 - protein, 224 aa, Homo sapiens; identical to SEQ ID NO: 38

SEQ ID NO: 699 - protein, 190 aa, Homo sapiens; identical to SEQ ID NO: 40

SEQ ID NO: 700 - protein, 190 aa, Homo sapiens; identical to SEQ ID NO: 40

SEQ ID NO: 701 - protein, 372 aa, Homo sapiens; identical to SEQ ID NO: 44

SEQ ID NO: 702 - protein, 748 aa, Homo sapiens; identical to SEQ ID NO: 46

SEQ ID NO: 703 - protein, 1307 aa, Homo sapiens; identical to SEQ ID NO: 48

SEQ ID NO: 704 - protein, 1142 aa, Homo sapiens; identical to SEQ ID NO: 50

SEQ ID NO: 705 - protein, 551 aa, Homo sapiens; identical to SEQ ID NO: 54

SEQ ID NO: 706 - protein, 430 aa, Homo sapiens [sequence omitted]

SEQ ID NO: 707 - protein, 500 aa, Homo sapiens; identical to SEQ ID NO: 58

SEQ ID NO: 708 - protein, 284 aa, Homo sapiens; identical to SEQ ID NO: 60

The invention claimed is:

1. A method of inducing a mammalian immune response directed to a 83P4B8 protein having SEQ ID NO: 24, comprising:

exposing cells of the immune system of a mammal to a protein consisting of SEQ ID NO: 24, whereby the mammalian immune response to the 83P4B8 protein is generated.

2. The method of claim 1, wherein the protein comprises at least one B cell epitope.

3. The method of claim 2, whereby the protein induces a B cell to generate antibodies that specifically bind to the protein.

4. The method of claim 1, wherein the immune response comprises production of an antibody that binds specifically to the protein.

* * * * *